United States Patent 10,407,724 (METHODS AND COMPOSITIONS FOR SCREENING AND TREATING DEVELOPMENTAL DISORDERS) - sequence listing, part 19

SEQ ID NO: 355 - DNA, 445051 bp, Homo sapiens
atttaatagcagcacaaactcttcacttttgtttggggaatattattgcttgcaggtctcacacatagcactgaatcttacaggtaaggagctggtgctaccctgttctcctttgttctcctgacccctgagaattctgggaaagtggttcacaagagagacttgaggttggattcacctgactgtaaaagtgctgacaatgggtgttcccactgttcctgtgacagagagcccaggcttcagctgctgaagaagaactcagacctaaccctccagggcgggacctttaatttggcacagagttggtccttagccaaataaaaattgaaaaggggagattttaaattttcatctaattaagactttatataatggatctttttcttattgtggcaacaagaggagagattgcattcttgggcttttattgttggaacttaataatactggctattctactgctcttgtggaattgtttggtctatgctggtacatggtacttgctatgaaacactgtctggtgagctggataggcaagtagctaaagaaaacgtcataagaaacagaaataggagttgagtccaatctctctcctgcactgcaagattctgttgcagtggtacctacacctattgccatagcaccccccaaattttctttaaagctaagaaaatagaaatagaggatggattctcaaatagatatacctagagttagttaagtaaagtctgattttgattctttcagaggtttggatgtcttagttatctcaggctgctgtaacaaaataccatctactgggtggcttaaacatttatttctcacagttctggaggctgagatgtccaagatcaaggtgccagcaggtttggttcttggtgtgagtcctcttcctagcttctagatagtgattttttttttttttgtacagtatttaccctggcaataataatcttatttttccatttggttagtttttcatgtatttattacttaatactagccaatttctccccagctctgtaaatctcccctcaacacatagaaacacaaaatcattttgattggtttgcctgcttgtatgtttgttcaagaaatttttcctggcccagcgtggtggctcatgtctgtaatcccagcactttgggaggcccaggcaggtggatcacctgaggtcaggagttcaagaacagcctggccagcgtggtgaaaccccgtctttactaaaaatacaaaaattagtcgggcatggtggggggcgcctgtaatcccagctactcgggaagctgagggcaggagaatcacttgaactgggcaggcggaggttgcagtgagccaagattgcaccactgcattccagcctgggcaaaagagcgagactccttctcaaaaaaaaaaaaaaaaaaagaaagaaagaaaaatttttcctggcacatttctatctgttccgttctggatgacttgctcttcaggcttatcccacagctgttatcataatatctctctttactgcaccatcttgggatttccatcgcctctctcttttgttagatcccctgcttcatggatctcaagggggttcattcttcactcacttcttccttttgatgatgcatatcctccaaaacctcctataaagtggttaccttagaaataaactttttgagacactgcatgtctgaaaatgtctattatacccatacacttaattgatattttactagatagagatacatagagataggttgaaataatttctctcaaatttttaaaagcactgcttttttttttttttttttttgaaacagagtctcgcctcgctccgtcgcccaggctggagtgcggcggcgggatctcggctcactgcaacctccacctgccgggttcaagcgattctcctgcctcagcctccccagtagctgggattacaggcacccgccaccacgcccggctaattttttaatttttagtagagatggggtttcgccatgttagccaagctggttttgagaggagagcactcctcatattgtcttatacttaatttcttgtttgctgaaaaagtggaggttgaaagaatgggcagaagtgaaaatcgtggtcagacaaccgggcgccacatttcgggccttgttgttaaaattcaacccctgacctcaccacttgcgctgtctataaattccagacattgtataaaaacgcattatgaaactcccttttctgttctgtttcgttctgattaccggtgcatgcagcccccagtcacgtacccctcgcttgctcaatcgatcatgacctctccctccacccacagcccctttagagttgtgagcctttaaaagggacaggaattacttattcggggagctccgtttctaggacgtgagtcggccgacgctcccaactgaataaagctcttaccttccacaatccggtgtctgagggattttgtctacgacctctcctgctacagtttcaaactcctgacctcaagtgatccgcctccctcggctttgcaaagtgctgggattacaggcgtgaaccaccgcgcccggcccttgttgtttactgtttccctatagtctttttttttttttttttttttttttgagacggagtctcgctctgttgcccaggctggagtgcagtggcacaatctcggttcactgcaacctctgcctcctaggttcaagcgattcttctgccttagcctcccaagtagctgggactacaggcatacaccactatggccagctaatttttgtatttttagtagagacggggtttcaccatattggccaggctggtctcgaactcctgacctcgtgatccgcccgcctcgggctccgaaagtgcagggattacaggagtgagccactgcgcccggcctactgttttccatagtcgtttctgagaaagaaaaagtaacccttttctgctctcagctagagctggtctgataaacacctaggccatgatgttctccggttcaaactaaaaatttcacaacaccaatatcagacaaagctaccctctcaccaagatgaaagaaagactatttcacaatcatatttgagcacaaacagaacactgttcaaaccataatatgatcaaacattcccctttcccagctactaatagtgactgttaattcttttattttttatttttttgagacggagtcttgctctgtcgccaggctggagtgcagtggcgtgatctcggctcactgcagcctctgcctcccgggttcaagcgattctcctgtctcaacctccggagtagctgggactacaggcgcccaccaccacactcagctaatttttgtatttttagtagagacggggtttcaccatattggccaggctggtctcgaactcctgaccttgtgatctgcccgccttggcctctcaaagtgttgggattacaggcgtgagccactgcacctggccttattttttattttattttatttttttgagacagtctctgtcacccaggctggagtgcagggacgtcatctcagctcactgcaacctctgcctcctgggttcaagcgattctcctccctcagcctcttaagtagctgggattacaggcatgcccaaccatgctcggctaacttttgtattgactgttgattctttaccaattatgtgtttagttctgcaaccattcctcccactttctagataaaaatatcgagattcccaggggaagaattgtcccacaatttccccatagtgtttgctgtctcctctgttgcaatgagccaatatactcagatttgactataggtttgttcctgatggttatagactggagcgcctcaacaccgtagagaagatggatgccgttctgattctttgttatttgccttaaactgttctcccagctcccctcccaaaagcttatagaatcttctacctgttcctactattctgaaacttcatgatctattttcatccaccatgctgggtacacagtgtgctctttcaatataggaatgtatattttggaggtatcattccaaagatgtttatgcatatacagttaaaggtatatatttatttcctgcaactaccatcacccttttgatatacttttgctgcataataaaccatcccaagcttattgacttagaataacaataagttattattttgtgaaggcaccaacatttgcccaaagcaagtcacatagccaatcccagattcaaacagaggagaaatagactctcttgatgagagaagctggaaaatataaccaacatttttttctttttctttttttttgagacggagtttcgctcttattgcccaggctggagtgcaatggtgcaatctcagctcaccgcaacctccgcctcccaggttcaagctattctcctgcctgagcttccctagtagctaggattacaggcatgtgccaccacgcctggctaattttgtatttttagtagagacagggtttctccatgttggtcaggctggtctcgaactcctgacctcagtgatccgcctgcctcggcctcacaaagtgctgggattacaggcgtgagccaccgcgcccggccatgacacaaagtttaaaagaaaaatttttaaaaattttttttggtcaggcgtgatggctcacacctataatcccaggactttgggaggccaaagtgggtggatcacgagtttgagaacagcctggccaatatggtaaaaccccatctctactaaaaatacaaaaaaattagtcgggggtggtggtgcgcacatgtggtcccaactactggagagactgaggtgggagaatcacttgaatctgggaggcgaaggttgtagggagccaagattgtgccactgcactccagcctgggcgacagagattcagtctccaagaaaaaaagtttttttacttttatagatattgtcataaggcaccctgtagaacttgtaccaacttatcctccattcacaaggtatattaaccttcccgccgggcgcggtggctgaagcctgtaatcccagcactttgggaggccaaggcgagcggatcacaaggtcagaagatcgagactatcctgactaacacactgaaaccccgtctctactgacaatacaaaaattagcagggcgtggtggcgggcgcctgtagtcccagctactcgggaggctgaggaaggaaaatggcgtgaaccctggaggcggagcttgcagtgagccgagatctgccactacactccagcctgggcgaaaatgcgagactctgtctcaaaaaaaaaaaaaaaaaaaaaaaaaccctctccaacataaactttaggaaaatttaccattagtttgggcacagtggctcaggcctgtaatcccaacactttgggaggctgaggtgggcatatcgcttgagtccaggagtttgggaccaccctaggcaatacagtgagccctcatctctacaaaaagttaaaaaatcagccaagcatgatggcaagcgcctgtagacccagctacttgggaggctaaggtaggaggatcagctgagcctgagggaggtggaggttgcagtgagccaagatcatgatactgccctccatcttgggtgacagagcgagatactgtctctaaaaaaaaaaagaaagaattccttggatatttctccttggtattttccttttgaactttataatcatattgtctagtttgaataaaaaagaaaaaattctttggacagttttatgaaaatcatgttaaattcagacaccaagtaaaggagaggtgctgtctttatgatgttgagtctcctatccaagaatatgatacaccctcggttaatagggaaggaggctgccctaatgcagtggttcccaaacttgaacattccaaactccctagagagcttgttaagtaacagattgttggggccaccctcggggtttctgattccataggtctaaggtggcactcaatagtttgcgtttatctcaagtttccaggtgatactgaagatgattgtcctgggaccacactttgagaataactggtcattttggagatggttggtggactatatgtaagtgagactaaagcatatttacactcttaaaaaataaaaagtactggtaaatgatccttagggaaaggaggtggaagatctgtaggaggagttgaaaaggaatgttcaggccgggagcggtggctcatgcctgtaatcccagcactttaggaggccaaggcgggcagatcacctgagttcaggggttcgagaccagcctggccaacatggtgaaaccctgtctctactaaaaatacaaaaattagctgggcttgatggcggtcgcctgtaatccccagctactcgggaggctgaggagggagaatcgcttgaacccgggaggcggaggttgcagtgagccgagatcggggcactgcactccagcctgggtgacagagcgagactctgtctcaaaaaaaaaaaaaaaaaaaaaaagaatgtctcttgaatggtgccaatcttggcttccacccacctggcaaaccaacttaacctacgccagcaaaagcaacagttaaagctaatttagcaggaacaaatgtaaggcaaacaactccaggctttcgggaacagaaaaaagttctccggtggatcaataactaattcaaagtagtggacccagcactctggagtggcagcctatattcatcaaataagactgcaactgttaactccctactcgctgccctacccgttcgtctttgctcctccttttctttgctcttccgcttctctcctccgcctcctcaacttcttttctagagccctctcctctttttcctgaccttcctaaaatggttgtattttacagccctttgcggctgatgaaggcttcaaaacctaaaaagcaaacagatgctccctaacacctagctgagaatattttaactcactacaaaggcctttcaaaaccccattcaaaatttcccaccaacaagaagagaaccagtatttccctctggagccgtcctaaggctgttctccctggagcagtgtcggagcgattttggactcttctcagagctgctcagcttgtctgccttcgcccagttgagaagcccatcgtggattcgaagtatgtggtcactacagacactagaatccccagattcctcttttcttttttttttcttttttttgagaccgagtgcaatggcgtgatctcggctcaccgcaacctccgtcttccaggttcaagcaattctcctgcctcagcctcccgagtagctgagattacaggcatgcacctccacgcccggctaattttgtatttttagtagagaaggggtttctccgtgttgaggctggtctcgaactcctgacctcaggtgatccgcccacctcggcctcccaaagtactgggattacaggcgtgagccaccgcgcccggcccagattcctcttttcttgatgaatttggggtgaatggagatgatttctggaatcagttaccataaaaggacagtagccgctgtggcgatttagaagttcatgtttccatggtagctaagcgagagggttaaataaaaacacagcgcccaacgtggggctcgaacccacgaccctgagattaagagtctcatgctctaccgactgagctagccgggcactgattactggcgtcttcttatgtggaatcattttccactgacggagcggttgtatgatctaattgcatattattgcgtgtgaaagaagtttcaggacctaggactggtggacacggcagtagccttttcataatagctttttgccatgaaggaattcggggtttagagagcgatgggggctgcagagagccaggaagtctcgcggaggactcgggaatcacgagtcctgcctgaaaccttagtgttttccgcacattccttccactgagggaacctcctcacccacttcagaggagggtgcgaaagagcccaaggaaactcagatgagaggcgcaaagacctctctgcaaagcattttaattctccatcctggaagaggcactgagttccagagtcacaagggaagggttctctcctctgctcaagtgaaggccaaaagaacaaccgtggtcccagctccgtgggcctccatatcgctctaaagcttcccgcctgggctgcttagcaccttggtgggcgagccgcagtgtgagccaactggaactattgttgtttgagacagggtcccgctctgtcgcccaggctggagtgcagtggcgcgatcatagttcattgcagcctctacttcccgggctcaagcgatgctcccacttcaccctccctaagtagctgggaccaaaagcgcccgccaccatcttaaaaattctttttctggccgggggcgatggctcaagcctgtaatcccagcactttgggaggccgaggcgggtggatcacgaggtcaggggttcgagaccagcctgaccaacatagtgaaacctcgtctctactaaagatacaaaaattagctgggcgtggtggcgggcgcctgtaatcccagctactcaggaggctgaggcaggagaattgcttgaacccgggaggcgggggttgcagtgagccgagatcgcgccactgcactccagcctgggcgacagagcaagactctgtctcaaaaaaaaaaaaaaaaaaaaaaattctgacattgtggggaggcgtctcaagctggtcgcgaactcctgggctccagggattctcccgcctccgagacttcccaaagctgctgggattacgtaatggcgcgagccaccacgtcggcctggagctattgttattcaccgaatctgtggactgcacttccgcggggatgccttaagcgaaggcagaattacaagcatgtgtcactcttttaaaagtgttaattaaaaaaaaaaaaaaccgccaccccagcaagttagaaccacctgccgtgactcggattcgaaccgaggttgctgcggccacaacgcagagtactaaccactatacgatcacggcgagccactaaccaggcggcgcgctacagctggatttaatgcctcttgaaataggaatggctatttcgtgctacttttatttggccagtccctgacgtccgcatcaatcaattccaaactttttcactctgcaaccttgaagctccgacacctgaatcagtttcttagactctaaatccctcgatgccagcgatagcaccacccgctccgctgggcggcggcgggccaaggtcctgactagagggcagaaagcgtcagctgcaacccgggaccacgccgcctctcgcctctctcctctcacctctctgcctccatttccctcttccccctccaaggaatcaagctgcttcgcccagggatgagaggggcagcctcgaaggatttttcaaattacatctgcagcctgtaccacggaattgaggtttctcttcccagaatggtggaaccggaagaaaaacggagctagtgagctggggaggggatgagagccccgtcttaatttcttgcttccctcacaggtacaagaagcgctgtgtactctctggcattgtgggagcttgtgctgacttcctcatcttgactcataaatatatcagagccacctctgccgattcagaaaaacaaatccaaccagcctctatttcagacacttccttagacccctaggagagttattgttaacttccctagacccctaggagagttattgtttggacgccagcggccgaacccatcagacgggctaggcgcgcacgtgcagttaccaaaatacagatgtttactgtgggagggacagaccatactggtgcagacctaggacacaaaagtggtcaaaactcttttcctgtgttccctactttgctcggtttccaggcctactcagtctaaaaagctgaagagaaaaactgacactgcgttggccgggaatcgaacccgggtcaactgcttggaaggcagctatgctcaccactataccaccaacgcatctgaaatacacttgattcctttagagtatcagaactaaataatcaggtttgtcttcccgtttatttctaggctaagcaatttagactgcaggaaaaacctacaagaggaaaattaaaaggaagctctctggaatttctcctattaaaaattctgtagtagtatcttgtttcacagctttaagaaaagtcaattctagtttcctggacatttattccacacatgcgcaaaattacatatgtacaagaccgtatatgacagcatttttttttccaaagagcaaagggctagaaataacctaagtgtctataataggaagctggctaaactaattatggaaaatccatacaacggaatgctatgtgccagaagaaagaatgaggaagttcttcatgtctaatctgtaagtacttccaaaatatactgttaaatggaaaaggcaaagtgcagaaagtgtgtatagattacttccatttgtacaagggggagagaatgtttaaatatatatacgtatgtatatatgcatgtacttgcatttgcataaaacatctctaacatcatgaagaaacttaacagcggttacttcattagagagaaaataaatggtagaggtgaaaggtttatcagttctgcccttttgtatatttgaatcctaaaccatgtaaatatattaccttttcgaaaatccagtaattaaattgaaagaaaatacgttactgaaggatatttatttccactgcaaagtgttagaaatacattgttaaccttaaaaatagctggtgttggccgagcatggtagctcacgcctataatcccgtcactttggtaaggcagaggcgggtggatcacctgaggtcaggagttcgagaccggcctcaccaatatggtgaaccccgtctctactacaaatacaaaattagccgggcgtggtagcgcaggcctgtaatcccagctacttgggaggctgaggcaggagaatcgcttgaacccgggaggcggaggttgcagtgagccgagatcgcgccactgcactccagcctggggcaacgacagcgaaactccgtctcaacaacaacaaaaacagctggtgataaaatagtattatagcatacttccactttgtttcaaaacctagatattgagtggtcttcgggtgatagaatggtgagcgatttctttatttgtgtttttctacattttctgtatttcagttttcagtgggatggggaagattgactagcagataacgtttatttaaaagatcctgagagaaagcagtaaaagaagatgttactctttccctgaccgggaatcgaacccgggccgcggcggtgagagcgccgaatcctaaccactagaccaccagggaagctgctaacccttcccggttgcagctatatgattctactaagtgctgcggttcgtgcctgtaactgctaaacactgaagccaaagtggccagattgctggagctcctagttcgagaccagcctgggcaaagtggcaaacccgggctctatcaaaagcacaaaaaaattagccgggcgtggtggcgcttgcctgtagtcccatctacccgagaggccggatcgcttgagcctggtaggcggaggttgcagcgagccgtgatcgtgccactgcactccaacttgatgacagggccagagccttcctcaaaaaaaaaaaaaaattacattattctaactaaaagtttatttccacttattctttttcatattatttttcactgcctagattctgagattcttgcatactgggcctttcctatgttggggcttcttcccggtacttctttcctgcagtagaaaacattgtgaaagaattctccagcccggctctcagagcctagggagcatcgtgtacacgtgattacagtccccaagaccagagaccaatgtccggagagaagagggtgagacagagaggaagctcacctccttgtagttgcagtgatttccgaaattgtgaacattagaaaagtagagacccagctacgtctttgccaaaaacaaccaggaacttttccttaaggaacataaaagacgtcatgcgagtaacactaggagatcctgggcccactgtaccttttttcatgtcgtgtgaattgtaggccaaactgttaaaacaaatattacagacgagtgaaaatcactcagcctagaggtacttggtgctcagcaggatctgagctcaactcactagtgggagactaagagaaactcagggcctttaacctttaaaaattacgaggtcccgggcgcggtggctaatgcctgtaatcccagcactttgcgaggccgaggcgggtggatcacgaggtcaagagatcgagatcattctggccaacatagtgaaaccccgtctctactaaaaatacaaaaagtagccggcgtggtggcgggcgcctgtagtcccagctactcgggaggctgaggcaggagaatcgtttgaacccgggaggcggaggttgcagtgagcggagattgcgccattgcactccagcctgggcatcaagagtgaaactttgtctcaaaaaaaaaaaaaaaaaaaaaaaataaattatgaggaagccgggcgcagtggctcagacgcctgtaatcccaggactttgggaggctgaggcgggtggattacctgaggtcagaagttcgagaccaacctggccaacatggtgaaatcctgtctctactaaaaatacaaaattagccaggcgtggtggcgcttgcctgtaatcccaggactttgggaggctgaggcgggtggattacctgaggtcagaagttcgagaccaacctggccaacatggtgaaatcctgtctctactaaaaatacaaaattagccaggcgtggtggcgcttgcctgtaatcccagctactcgggaggctaaggcaggagactcgctttaacccaggagacggaggttgcagtgagccgagatcacgccattgcaccccagcctgggcaacaagagcaacacaaaataaaaattgcgaggaaggaaaagagggagtgaagagaaagaaaactggggtgcatgcattaatgtgttgcaagctaactttatgagcgagaaaagaaagcaaatgcgggctggatacagtggctcaagcttgtaatcccagcactttgggaggctgaggcaggtggattgctttgagcttaggagtttgaaaccagtccaggcagcagggtgaaatcctgtctgtaccaaaaattacaaaaaaaaaaaaagaaaaagaaagaaagaaatcttagtgaattgtgtttgccatattgtactttcagcttttctgtaagcttgaagttttaaaaaataaaaggttaagaaaaaaatgaaacaatcaaaagcctccccttctggtcttttttggtcagatgaccccaagtgatgaattctgtgcccatgagttcaagcagaaatttttaaaagcaaccccactccccaaacacactcttacatcagaaaatatttttgataatgaatttaaaaactgaaagattgaatcatcaatggtgtctgtatatcagcaaggcctgacagaaaaaaaaaatggatggtgagatacagagtttggggggattatcatagttgttgttttgagacacggtcccactttgttgcccagactgtagtgcagtgctgagctcctacctcagcctcctgagtagctgggactacaggttccggccaccacactcagctaattttgtgtctgtggtagcagagatactaggcctcaccatattgcccaggttggtcttaaactcttgggctcaagccatcctcccacctcggcctcccaaagtgctgggattacaggcataagccacgaagcctggtcttgtttggcttccaaagtatcaatgttaaaacgttgttcaagaaacgttgtttaaatcttccactcatccagtctccacttttctatgggtttaaatgccataaaataggaagacgagtaactaaatgttagacatttattttcacaaagacaacaagaatcctgttgtcatgtcaccaaggagcctaacagagcccacttccttttactccagctgttttcactggaccaaggctgaaaaacaaaaagcatctaaccttcagaacaacatctcaggatcttacccagagtggggacaaggcagcagaatttatttttctatgttgcagaggaaatcagcctcctgttttggtcaacagtactttttcatcaattattctgccacctgctggtaattttttgttaaggacagaccgaggaaggacagacagtatgagctatgggagctagccacttgtctcaacatcaaagtaccagaaggaatctggtcaaagcaccaagacaggattaagcctcctcttcttgccggtaatgcatacctaaagtggatgagggaggagtgtggctcatttgcttcactctgagttctattttccttttttttttttttttttttgagacagagtcttgctctgtcgcccaggctggactgcagtggcatgatctcagctcactgcaacctccacccctgggttaaagcgattctcctgcctcagccccctgagtagctgggactacagatgcccatcaccatgcccagctaatttttgtatttttagtagagacgggatttcaccatattggccaggctggtcttgcactcctgacctcaggtgatctgccagcctcagcctcccaaagtgctgggattacaggcatgagccaccgcacctggcctattttcctttttaaaaacatttacagatcatgtgccagacgaggtattgaaaatctaaaaatacacctaagctgggtgttgtggctcatgcctgtaatcccagctacttgagaggctgaggcacaagaattgcttgaaccccggaggtggaggatagggtgagctgagatcatgccactgcactctaggctggtgatagtgcgagactctgtctccaaacaacagcaaaacacttaaagagctgaaaatctagtgtaaaaccaaataaacaagtgaataaaagagaatggatcagggaggattgagtagatgtgatcttccctcgtcctcctccctggacattatatataagacaaccctaagaagactgaaatgtggagagaaggaggtagaccagctaggagccccagaaacaaaggcaggacacaatgctgatttctgtggactttctttttgcctcatatatgccatacttggagctaaagaaaccagcaacctggaaatcccaataggagcagcctaaaaattccctaacaaaagcctgttctctctagccaaaggatcaggaatgaggcagtctagcaaaacagaaaacttttagacaataattgcactattccagccaaatgccacagaaacaaactgtggcttgtcctctcctattctggcaaagactgaatggggtgcctagacttccaccaccagcaagtctattaggaatcatccctctctttcctgttggggtggtagcagaagaaacttaatagagagtcaggactttcacccaaactcagtgagtggtaatgaggctaccccctaaggaaagaatcagtgaactgaaagaacagtagaaattactcaatctgggtcaggcgcaatggctcacgcctgtaatcccagcactttgggacaccaaagcaggcagatcacttgaggccaggagttcaagaccaggctaaccaacatggcaaaaccctatctctactaaaaatgcaaaaacaattagctgggtgtagtggcacacacctataatcccagctacttgggaggctgaggcttgaacctgggaggcagaggttgtagagagcgaagatcgtgccagtgcactccagcctgtgcaacacagtgagaccctgtttcaaaaaaaaaaaaaaaaacaactcaatctgaaaaacaaacaaaatagactgggggaaaaatgagcagagagcctcagggacttgtgagattataacaaaagatttaggccaggcacggtagctcacgcctgtaatcctagcactttgggaggccaaggcgggcagatcaccaggtcaagagatcaagacaatcctggccaacacggtgaaaccccatctctactaaaaatacaaaaaattagctgggcgtgtgcctgtagtcccagtttctggggaggctgaggcaggagaatcgctttgaacccgggaggcggatgttgcagtgagccaagatcgtgccactgcactccagcctggcaacagagcgagactctctctcaaaaaaaaaaaaaaaaaaaaaagatttaacatttgcgacagcaaatttcctggaaggagaagaggaagagaacacgacaaaaaaagtaccaaaggatttggtacagggataaacctacagattcaagaagctgaatgaactcctaacaggataaacccagactacttcaggccaagacacattgcaatagtttggatgtttgtcccctccaaaacttatgttgaaatgtgatccccaatattggaggtggggccaaatgggaggtgtttgggtcatcagggtggatccctcatgaatagattaatgtcctccctcaccagcaaatatgttctcactcttagttcctgcaagggctggttgttaaaaagagcatgtcacctaacctcttttctttcctcttctcttgccattgatctctgcccaaaccaacttctcttcaccttccactatggttgggagcaatctgaggcccttgccaaatatagatgcccaattttgaactttccagccatcagaatcgtgacccaaataaaccatttttctttataattacccagccctcaggtattcctttatagcaacactaaatgaactaagacacacatcatagtcaaactgctgaaggctaaagacaaacaaaaaatattgaatgcagtgaggggaaagcaatttgaataaaagcagatttctctctctttttctttttacttattttgttttgttgggttttctcccatgttcaaccaagttagaaagccattttctcatcagaagccatggaggccagagggaagtggcacaaaattgttcaagtgctgcggaaaaagactgtcaactcagattgctatatccagtgaaaacatcctttaaaaatgaagggggtatgattcaacaacaaaaagacaaataacccactgaaaaaataaatatgtgaaaaaatgctcaatgtcaactgggtgcggtggctcacgcctgtaatcccagcactttgggaggccaaggtgggcagatcacctgaggtcaggagttcaagaccagcctagccaacgtggtgaaactatactaaaaatacaaaaattagccgggtgtagtggcacacacctgtagtcccagctactcaggacgctgaggtaggagaattgtttgaacccgggaggcggaggctgcaatgagccaagattgtgccactgcactccagcttgggggacagagtgagactcagtctcaaaaaaaaaaaaaaatgttcaatgtcattagtcattagggaaatgcaaataaaatcacaataagataacacttcaccaccagaatggctataattttttaaaatggaaaataacaagtgttaggatagggagaaatttgaatcctcttgtattgctggtgggaatgtaaaatggcacacctgctgtgaaaaacagtttggcagttcctcaataagctaaacatacaactaaatatagaatatgattcagtaatttcactcctaggtatataccccaaagaactgaaaacaagcacttaaaaaaatacttgtacatgcatgtggatagcagcactatttataacagtcaaaaagtggaaacaatccaaattccattaatagatgaatggctaaataaactgtggtatataaatacaatggcatattattcaggcataagaaggaatgaagtattgatacatactacaacttgtataagcctcaaaacattatgctcaagaagccagacacgccgggcatggtggctcacacctgtaatcccagcactttgggaggctgatacaggtggatcacgaggtcaggagatcaagcccatcctggccaacatggtgaaaccccatctctactaaaaatacaaaaaaaaaaaaattagctgggcatggtggtgtgtgcctgtagtcccagctactcgagaggctgaggcaggagaatcgcttgaacctgggaagtggaggttgcagtgagcagagattgcgccactgcactccagcctggccacagagcaagactctgtctcaaaaaaaaaaaaaaaagccggacacaaaaggtcacatagtgtattattccatttatatgaaagtcaagaacaggtattaataaatctagagagacagaaagcagactggtgatggccagaggctgaggactgactggctaataggtacaggatttcctttcagggtgatgaaaatgttatggaactagatagtggtgatgttttgatggttgcacaacattttcttttcttttttctttttctttttttttttttttttgagatggagtctcgctcttgtcacccagcctggagtgcagtggcacgatctcagctcactgcaacctccgcctcctgggttcaagtgattctcctgcctcagcctcccgaatagctgggattacaggcacatgccaccacacccgactaatttttcttatttttagtagagatgaggttttgtcatgttggccaggctggtcttgaactcctgacctcaggtgatccgcctgcctcagcctcccaatatgctgggattacagtcatgagccaccgcgcccggccgacaaaattttcaatgtactaagcgccactgcattgtatacattaaaatagttaaaattgtgaactttatgttgtgtgtattttactacaacaaaaaaataatgaagggggccaggtgcagtggctcatatctgtaatcttagcactttgggaggccgaggcaggcggccgggaggtggaggttgcagtgagctgagatcatgctactgcactctagcctgggcaacattgagcattgagtgagtgagactccatctaaaaaaaaaagaagaagaaaggaaaatcctagcaggattttctacagatacagacaagattattactattactattattattattatttccttcgagatgaggtttcactctgtcacccaggtggagtgcagtggcgggatctcagctcaccacaatctccacctcccaggctcaagcgatcctcccacctcagtctccagagtagctgggaccacaggcgcatgccaccacatccagctaatttttttgtatttttggtagagacaaggtttcaccatgttggccaggctggtcttgaactccggagctcaggcgatccacccacctcggcctcccaaagtgctggaattacagcatgagccaccaccttgttttaaaaatctgtaactttaagacaagagaccgggcgcggtggctcacgcctgtaatcccagcactttgggaggccgaggcgggcggatcacgaggtcaggagatcgagaccatcctggctaacacagtgaaaccctgtctctactaaaaatacaaaaaatcagccgggcgtggtggcgggcgcctgtagtcccaggtactcggaaggctgaggcaggagaatggcgtgaacccgggaggcggagattgcagtgagccgagatcacgccactgcactccagcctgggcgacagagcgagactgcgtctcaaaaaaaaaagacaagattattctaaaagttatatcaaaggcaaagaagcggacatagctaaaacaatttttaaaaataattaaatgaggttgggcgcggtggctgacacctgtaatcccagcactttgggaggccgaggcgggcagatcacttgaggtcaggagttggagaccagcctggccaaaatggcgaaaccccgtctctactaaaaatacaaaaattagccaggcgtggtggtgtgtgcctgtaatcccagctattcggcaggctgaggcaggagaatcacttgagcccaaggcagggaggttgcagtgagctgagatcatgccactacactccagcctgggcaacagagggagactgtctcaaaaaaaaagaaagaaagaaagaaagaaggaaagaaagaaagaaggaaggaaagaaggaaggaagggagggagggaggaaggaaggaaagaaagaaagaaagaaagagaaaaagaaagaaagaaaagaaaaaagaagagaaaaagaattacatgaattaaagactgtgtggtattggcagagggataaatatacagatcagtgaaacaatatagaaaacccagtagtagacccacacaaatatacccaactgatttttttttcttttttttccaatgagaaaatgctaaaacaagcaaaacttcatgaagggacatctcatcaaagacgatatacagatggcaaataagctcataaaaatattttctacatcattagccataagggaaatacaaattaaaacccaaattagatatcattacacacctatcagaatggctaaaaaattgttgacgacatcagccaagtgcagtggctcacacctataatcccaacactttggaagtctgagggggcagatcacttgaggtcaggagtttgagaccagcctggccaacatggtaaaaccccaccactactaaaaatacaaacaatagcctggcatggtggtgcacacctgtggtcccaactacttgggaggctgaggtgggaggatcccttgagcccaggaggtggaggttgcagtgagctgagatcacaccactgcactccagcctgggtgacagagtaagattctgtctcaaaaaaaaaagaatctttgttggtaaattccttcaggttttggtgtgtttgaaaatgttttacttatttttaattctggaataatattttagctgagtatggaagtctaggttggcagttactatctcttggcttatcagagccacaccacaactgtattctcaacaaaagagagatgacacaccactctgctaccacaaaaatgaccagataatcccctcttcagactaacatgagtaactaatgcttttttctctttaccaatttgggttataatcctcttgcttcctaggtaagaattatttagacacccaatcactgaaacgcccccacttcttaacagtattcaatcccaaattagtcctcattcagagttttagagactaggaaaaaacaaacaaacaacaaaatcagccctcactattctaaactgtagttcagaaatatccaacagaagctgaaactctataagaggttccttttaacctctccttagggaaatggtcccataattcctttggggcattctctcccttgctacagcaagccagtagatttaacttttttgactacagatttgtttccagtggtgtttagttaatgagctttgacaaagataatggtcaaatttctccaatatcaattgactatgtgaagaatatatatatatatacacacacacacacacacacacacatatttgtgtgtgtgtatgtaatatatacatatttatataagaacatattggcagggcgcagtggcttatgcctgtaatcccagcactttggaaggccaaggtgggcggatcacttgagcccaggagttcgagaccagcctggccaacatggcaaaaccccatctctactaaaaatacaaaattagctgagtgtgatgacacatgcctgtaatcctagctactcaggtggctgaggcatgagaatcacttgaacccaggtggcagaggctgcagtgagccgagatctctgggtgacagagggagaccctgtctcaaaagaaaaagaaaagaaagaacgaacccaggtcatttgtcctgtagagtattcacaaagtctgaatttgcacctttgagttaccacttaatgtctcctgtatttcctgtaaattagtagttagctctaatcagattcagactggtttgtttgtttgtttgtttgtttgtttgtttttggtatggctacttcatgcaaggtggagttatgtactctatgatcaggaaaacatgtttatctctgttttcatgatgaataacagccactgtttttttgtttacgtagagatgggctcttactatgttgtccaggctggttttgaactcctgggcttaagcaatcctcccacctcagcctcccaaaatgctgggattacaggtgtgagccactgtgccctgccacagtcattgttgaccattgcctagatatattaattcatttggatttacaaaatgttgatattctaattatattatcccttcttcaattatttactggaatgcttctataaagagaaatttccccctcatcttgagatacagttcccaaaagaaaaccaggataaatacttgattctttccaattaccagcagtttttaaaataatgagttgatctgccagcattctccaacaatgaccaatgggtttgtatttttaagtatcattgtgaattcatggatttaaacatattttatgaatttcaatccattgcagatagtatccattttgatacttaaattgccccatctttggccaatgggaactattctagttggctcctaagttcttttattacaatcctaacactctttgaaagcttccttgcctatcttggacaatacctgccccaaacctgaaatcagccacttatccaaggagttgtttgttggtcccttttaacagaaaatggtatttacatagcacaatttgagtactagaggtgtttatttttactggatcattgtttccaggcctttttagggtaaagctaggaaaattttaaggataaaataaaccatgagttcagagttatatttgcaatttaaattcagaattacggagttttctcttaacttcatcaatcgtaaatatgtatctctttattccaccccaaaaattctggttctcagagacactaacattattaatcatttgttttatctcataactaaaataatctcagaataacaataccaacactaacaccataatatggctatttaaaaatatttttgcatttattttctggcattatagtatatcccacttaggctgtcatagtcaaattattatgttttaaagtcacttgaatagtttggttagaagcattttacatttctataatgaaactgcttgtgatatggcctctaatggttgagaaatatttgtcatatatatatacctgagaagtatatatttgacaaaaatatttgtcatatatatacctgagaagagtgctatgagggcctctagactctgtattaaaatagagccaactggtaaagatggcttagtgattgtgttggttattactgagtgtcaatttgattggattgaaggatacaaagtattgatcctgggtgtgtctgtgagggtgttgccaaaagaaattaacatttgagtcagtgggctgggaaaggcagatccacccttaatctgggtgagcacaatctaattcactgccagcacagctagaataaaaagcaggcagaaaaatatgaaaggagagactggcctagcctcccagcctacatatttctcccatgctggatgcttcctgcccttgaacatcagactccaagttcttcaattttgagactgagactggctctccttgcccctcaagcttgcagacagcctactgtgggaccctgtgatcgtgtaagttaatacttaataaattcccctttatttatatatctacctatatagatatccatatctatatagatattaataaatctagagagacagaaagcagactggtgatggccagtctagatggctagatagatagacatggatatagatatagatctctatatagatagaggtagatacagatatagatatatgccctattagttctgttcctctagagaaccctaatacagtgaccgtatttggaatcggtccttctgttaatttcacttggcaagtactaaaagatgatgatctcagatatacctatggctgcaaaaacatgacatggctaaatcccttggttgcagtatctcttttcttttttaaggggggtgggggggcgggtctcactgttgcccaggctggagtgcaatggcgttatcatagctcactgcagcctcaaactcctgcgctcaagtgaccctcctgcctcagctcccaaagtgctgagattttgcaatatttatggtcacaagattatgttattccataaaagtatctttctgaggctaggcatgttggttcacacttgtaatcccagcactctgagaggctgagatggaaggattcattgaggcaaggagttcaagaccagcctggtcaacatagtgagacctcatctcggaaggaaggaaggaaggagggagggaggaagggagggagtgaaggaaggaaggaaggaaggaaggaaggaaggaaggaaggaaggaaggaaggaaaagtatatttttgaatctttttctatttctccaactctttctttagaagaattctatttccattctttcttcacctctttgcctttgttagccttctctccaagcaaatcgggagcctttattttttgtgtattcatgagggagaggaagatgaattgctgtacaaactaaagtaatgaaaatggagtaggtaggaggatagacagctgcaaggatctgagctggatagactgaacaaaccctcatcctaagcaactcacagctcagatttcttctctggacagctggcttttttcgtccttctgaaatactctgcaaagataggagaggggctatgaactacctctgctatggatcttattcaaagtcagctacctcctagatactatctgtagaacctaaatgtaatattcagcatagcagggatgaacatggtaaatgaaaggtatccaattgcccactgtaatttttaaaggccaggagctcaacattattgaaaatgctggagggctgcctggagtaggcagtgaccacagagtcacacaagctggaattggatatccaacttgtctgtcatatttctctcctccctccctgacttggcactcaatactccatattctttctaatcctctaaccctccccactcccccaactcccacaccctacccccaccaacgttcctggaattttggacttagctatttttaaaaccgtcaactcagtagccacctccctccctgctcagctgtccagtactctggccagccatatactcccccttccccccataccaaaccttctctggttccctgacctcagtgagacagcagccggcctggggacctgggggagacacggaggaccccctggctggagctgacccacagagtagggaatcatggctggagaattggatagcagagtaatgtttgacctctggaaacagtaagtcaaaatgaaattgcaattcctttaataagcttttatattgaagttagacttttataaaattacaaacacctacttggatgtctctcgtccaaatgctgggatctctccctaccaaggtgccccaatctccatttctctttctgtcttatttctttctggcctctggcctctagctttttgaagtttaattctctgtctctcctctggcagtcttagccctctctttaccttattacctcaagactcctgatgaagttttagaaggagttccctacgtcctctattctgtagttttcttaccaaggccaaatatgacctcagatgatgagtcactgatacccttctatcctgcccccacttagcaatgcccttcacattgagattccaagcatgggggctgctccctgtaaatgatttctccccacaactctagtccctccattctattctccctcttgcaggactcttcccccaatcatatccttacccataagataggggagttaggcaggagggatttagcccctctccaactcctgtcatcataaaagactgagaacttcagaatttgaaaagaagagattaatggaaggagtgatatttgggaaaatacaagaactgttgacttagaaaaaacaaatattgatttgcatgtttggtttgcatcccattattccatgagagagggagattaaaattgcagctctctagagctgatgaaaagagattggtttccttttcatttgaatactgatattctagacgggatgggtatgccacccttaatccttcttgtgttctgacacaaaggaggaaaagaaatgtatgactcctagagggcatctcctcctaatggagagggacaaataagaagtatgtttctgaaatattttcaggtcctaattttactagggtacccactaggattactggtatctgatctagccccatgattcctccatctttgacatacctgctgtttggtagctcagaatggagcaatacagtggactctgcccccttgagttcactcaaccttccctccacccccacctaggggtattgcacaagggccctaaaagtggccacaggaacagggcaaagaggcttaactgccacacttatagtttgaggaactccaatctccccaaattccagtctgttcatccttttcttgatctccccagattcactccacattatccttaccaatcttcaattcttctctctctccatgtccagccaaatttcttttttcagtcacttacagggcttccggtcaaaattcactaggtaggagggtcatcagctgggaagaaccggcgcctgggaaacctggctggataggtatgggggagccaggccagtcccctagtcccaggtcctcccatggcagtcccccaactctaagcactctcactctcctgctgctcctctgtggacatggtaaggaagggccagggaagggtttggggaaatctagagggtaggctgctatgtaggggtgggcatgtgagcctgaatgagtgaggagagataggcgctgagagtcccgatcactcgccctgctctcaaatactaatattttatttcccgttcagtctggggaaggccactggggaagcccttggtcgacaggcagaagagatgtggcaggcttacacacttttagtaagacagccgagagaactagggactagggggttgggggctggggaaggcccttagttaggttttaggaaggctggaaacccctgatgagatttggaagagttatgagcaaactacactccgatagagcagaggtctgaggaccgtctcacaatcctctcccttctgtctttagctcattctcaatgcaagatcctccgctgcaatgctgagtacgtatcgtccactctgagccttagaggtgggggttcatcaggagcacttcgaggaggaggaggaggaggccggggtggaggggtgggctctggcggcctctgtcgagccctccgctcctatgcgctctgcactcggcgcaccgcccgcacctgccgcggggacctcgccttccattcggcggtacatggcatcgaagacctgatgatccagcacaactgctcccgccagggccctacagcccctcccccgccccggggccccgcccttccaggcgcgggctccggcctccctgccccggacccttgtgactatgaaggccggttttcccggctgcatggtcgtcccccggggttcttgcattgcgcttccttcggggacccccatgtgcgcagcttccaccatcactttcacacatgccgtgtccaaggagcttggcctctactggataatgacttcctctttgtccaagccaccagctcccccatggcgttgggggccaacgctaccgccacccggaaggtcaggcactcaatcttccttccgatccacctcatgagattcttccacgggcaccattcctccccatccccactattcaacagcaatgctccctaattcccttttcttcctcaacctctcccccatctcgaatcactcccttctaccaaacacctggagctgtaaatcacttccccttgatgggaatttgactcaaatgcagaaaaccttgaagagacagtcggagagggcggacctgaggagtttcagaagggaaacttttccctctcctaggaagttgccacgattaagtagagagggggttaagtagggatgaggtaatactggaacataaataggagaagggatcaaggattgagggccatagtagtcctgcatctctacttggatcagatctctaactatgtatgaggtctgattggggggaagatgcactgaacccaaaatgaactgttttccctcttgtcctcacagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatcctctgttgcctatgttgaatctctttacagatgcttgaaatggagtaaatgcaatgtgttcactccactgaaagagggctcggaagtatcagatactgttgctatctcagggagtttacaggctattggagagacaaaaccaattcacatgaaagagtgatgagtgtgtaattattcactaaatcctacagtatggtacattcagatgggaagatggtagatttgaactaaagtaataagaataataaaaggtaacagagaagatgggatttgaagtgagctttgaagactgggtaagattcaaattgttaacgatcttccaggcaatgaaaaccatctggagttatgcatggattcatgattcagcaaggaaatgagcaaaactcaaatgcagtagacaaggagtaatgggacagaaggttagatgggcagaggccagattatgaagcaccttaaaaagggggtaaggggtttaaatttgattaatatctaacacttattgaaacttaaaatctgccaggcaatgttttaaacacttttaaaacattgacttaattctcatagctctctaaggaaggtggtattcttatctctatttttatataaggaaacttgcctccagtcacacagctaacaaattatggaacttgcctccagtcacacagttaacaaatggcagagccagaaactgaacctatgccgtttggatcccgaaacttaatttttaatcactatactatattgtcaaggaagcagagagccattaaagattctggttgtggagctggtaaagattctaaaaggggagttgtggtggtcaatgtcaccacaaaagctactctgaggctgggcgcggtggctgacacctgtaatccagcactttggtaggccaatgtgggtggatcacttgaggccaggagttcgagaccagcctgggcaacatggtaaaaccccatctctactaaaaatacaagaaatttgccaggcatgatagtccatgcctgtaatcctgtaatccaagctactcaggaggcagaggcatgagaatcgagaattgcttgaacccgggccaggaggcagaggttgcagtgagctgagaccacgccactgcactccagcctgggcaacagagtgagactatcaaacaaaaaacaactactctcttctcatattctcatataaagccaaaaagagagagttggaaaaggagggaaagcccaaagttgaaggaatctagtttgtagaagaaagactgagaagaaatgctgttctagatgagggtgctctaaagtaacaatgctgctctgaacaaaattatgaaggaggtaacttttacatttaatatcttccctgtttctggtctcatcctcccctctcaggtactccataaccgaggacctgtcctccctgccctaatcaagtactcaccattatcttccacctctcctctcagtccctgacacccgacaatactcccctgaacaaatattacagtagggccctttgtatctactaattctgcatccacagattcaaccaaccacgcactgaaaatatttgggaagtagccgagcgcagtggctcacacctgtaatcccagcactttgggaggctgaggcgggtggatcacaaggtcaggagtttgagaccagcctgaccaacatggtgaaaccccatctctactaaaaatacaaaaaattagccaggtgtgctggtgggagcctgtagtcccagctattcgggaagctgaggcaggagaatggcgtgaaccccggaggcggagcttgccgtgagcggagatcgcgccactgcactccagcctgggcgacagagcgagactccgtctcaaaaaaaaaaaaaaaaaaaagtaataaggctagctctaagcccgcgcgaaggaagagtattacatgacaggtgtcatcaaagaatttcacttaccacttggctgtgaaattcttttttttttttttttttttttgagacggagtctcgctctgtcgcccaggctggagtgcagtggcgcaatctcggctcactgcaagctccgcctcccgggttcaggccattctcctgcctgagcgtcccgagtagctgggactacaggcgcccgccaccacgcccagctaatttttttgtatttttagtagagacggggtttcaccgtgttggccaggatggtctcgatctcctgacctcgtgattcgcccgcctcggcctcccaaagtgctgggattacaggcgtgcgccaccgcgcccagccgaaattcttctcaattcacttgaaattcccacacctgagggataaagttactcttttaagagaaccaatacaaagagtatttcttcaaaaggatgttttgagttaaaatacctatattttctgtgaagtgaagagacagccctggatatgtctcttcccccaatttttttttcttcattacaacacattattttctccattagctaaaggttactttggaaagcatagagacagtgctttgagggaatggcagaatggctgtggtccttaaaagaggtggagaggagggaatagaggataaagaattgcaggagaaatttgaaatggcagaccagatacgtctcgaactcctggcctcaagtgatctgctcgcctcagcctcccaaaatgctgggattataggcatgagccaccatgcccagcccaactagccctattattaatggagcatttttaaataggtagctcaaaataagcatatgaaaagatgctcaacatcattagtcactggggaaatacaaatcaaatgaaaacaacaatgaaaaaatactacatacccactagaatggttaaaatggaaaagactgttaaataaaatacaaaatgttaggaaaatgtggagctttcatgtgctgttggtgggaatgtaaaatggtacaactactttgtaaaacagtttggcagttcgttaaaaggtaagtgtacacttaccatacaaaccagacattccaaacttaggtactgacccaagagaaatgataacatgtgctgcacaaaaacttatatacaaatgcttataacagttttatctgtaataaccaaaaactggaaacaactcaatgttgaaatggtgaatggatacaccaattgcagtaaattcacataattgaatacacagcaataaaatgaaattaattcctgatatacacaacatggataaatctcaaagtaattatgcaagtgaaaaaagctgttgccccgcaaaaaaaaaaaaaaagagtatataccatctgcttccattcatatcaaattattaaaaatcttcagcagatcatggactgtaaaaatatataaaatgttagcaaacatatagtgagaaaaggtgatcaatggttgcttaaggaatgggcagagtgaaggagggatggcttacaaaggggcatgaagtaggccggatgcggtggctcacaccagcaatcccagcattttgggaggcttaggagggtggataacttgaagccaggggtttgagaccagcctggccaacatggcagaaccctgtctctaataaaaagccctgtctctactaaaaaccctgtctccactaaaaaccctgtctccactaaaatgccctgtctctactgggtgtggtagcatgagcctgaaatcccagttactcaggaggctgaggcacaagaatcgcttgaacccaggaggtggaggttgcacaaagccgacatcacgtgactgcactccagcctacgcgatacagcaagactctgtctcaaaacaacccaaaggggcatgacgaaactcatgggggtgatagatatgttcatcattttgattgtgacagtggtttcatggatatatatatatatttgtatatgtcaaaacccatgaaatgacacaccttaaatatgtacaatttatcatacaccaagtatatgtcaataaagctgtagtttttttttttttttaatgagtagcacatctttctctcttttcttggtagatcagacaaaaggcttagaatgaccatagcatgacaaggaagattacaacagagacttttcttcttctaggaaacatacaaaagaagaggataacagaacaaaggaaagaccttatttagtgattttatattctccgctactcctatgacaaggaccacattccttcctccagaatgtcattctcaaagtcagagaccacagaaaggagattttccgatttaagaacatcaaccctgtgaatcataattctgtctttccacttcaccaagagtcagcaggtggtgctagtgactaaaaagtgacttggcagacaatgaggcaagtttccaggaaaagaaaaattatcgtctaagattatctgatatgttgaccatttgaaagaaaatattaataggcatttgccagaattgacatttaggaaataaactgaagataggtacatagtaaacaaagtaaaattttaaataaattataatttaacaataaagggttgttcaagacatgaaacaatcaatatatactacttggctcctcaatggatatcatttacacagtaatactaatgtaaacactgactattgattcagccagaactatgctataactttctattgggaggatgaggtaaggggaaaggaaaggtgggaatatagcatgatgtaagagttaaaatttcaattactataaccataagagagtagatatgtctaatatttattttgtttccttttttttttttttttgagacaagagtctctcactgttgcccaggctggagtgcagtggcgcaatctcagctcactgcaacctctgcatcccgggttcaagcgattctcctgcctcagcctcccaagtagctgcgactacaggcatgcaccaccaggcccgtctactttttgtatttttagtagagatgggtttcaccatgttggtcaggctggtctcaaactcctgacctcaagagatccatccacctcagcctctcaaaatatatatgtaatgttagcacatatatagtgagaaaaggagctcaatggttgcttaagggatgggcagagaggaggagggatggcttacaaaggggtatgaagcaggctctgtcgctctcgctgtatcgccagactggagtgcagtggcccaatctcagctcactctatcctccatctcccgggttcaaacaattctcatgcctcagcctcccaagtagctgggattacaggcgtgagccaccacacccagcctagttgtatttttatattttcaacacctagtctggcacatgatctgtaaatgtttttaataaggaaaatagtccaggcacggtggtttacgcctgtaatcccagcactttgggaggccaaggctggcggatcacctgaggccaggagttcaagaccagcctggccaacatgggaaccccatctccactaaaaatacaaaaattagcccagcgtggtggcgtgggcctgtagtcccagctatttggaaggctgaggcaggagaatcacttgaacccaggaggtggaggttgcagtgagctgagattgcgccactgcactccagtttgggtaacagggcaagactctctctcaaaaaaaaaaaaaaaaaaaaaagaaagaaagaaaaagaaatatgaagtgcataccagatgaaaaagctgaaagaggcagggtgcagtggctcatgcctgtaatcctaggcatggatttaagaggcctaggtagatggatcccttgagcccaggagttcaagaccagcctgggcaacacagcaaaaccctgtctctacaaaatatataaaaattagctgggcatggtggtatgtgcctgtagtcccagatacttgggaggctaaggcaggaggtacacctgagcccagaaagtcaaggctgcagtgagccatgatcatgccactgcactctggcctgggtgatagagtgagatcctgtctcaaaaacaagggggcgggggccgggtgtggtggttcatgcttataatcccagccctttgagaggccaagtggggggaagatcacttgggccaggagttcaagaccagctggcctacatggtgaaacctcatctctactaaaaatacaaaaattagccagacgtggtggtgtgggcctgtaatcccagctatttgggtagctgaggcaggagaattgcttgaagctaggaggtggaggttgcagtgagccgagatcgcaccactgcactccagcctggggctgagattgccccactgcactccagcctgggtgacggagtgagatcctgtctcaacaaaaaaaaaaaaaaaaaaaaaaaaagaaagaaagaaaaagaaaaaggggcttgggcttgaggactgctgttttttgtaaaatcatttaatatcatgtgatttttaactacatgttacattacattgattaaaaagaggagcatttggctgggcgcagtggctcatgcctgtaatcctagcactttgggaggctgaggtgggaggatcacctgaggtcacgagttcaagatcagcccggtaaacatggtgaaaccccgtccctactaaaaatacaaaaattagctgggcatggtggtgcatgcctgtaatcccagctacttgggaggctgaggcaggagaatcgcttgaacccaggagtccgaggttgcagtgagctgagattgtgccactgcagtccagcctggagacacagtgagactccctctcaaaagaaaacccaaaaaacaaaaagaggagcatttctgggcaggtgcagtggctcacgcctataatcccagcattttgggaggccaaggcgggtggatcacttgaagtctgaagtttgagagcagccgcggacatggcaaaaccctgactctactgaaaatacaaaaattagccgggtgtggtggctggcacctataatcccagcggcttgagagacttaagcaggagaatcacttgaaccggggaggcggagattgcagtgagccaacatcatgccactgcactccagcctgggcaacagagtgagacttcattccccaccctcaaaaaaaaaaaagggagcatttccaccttggcctgagctttttccccttaactttgtggccatctcaaccacttctcagatcaaacaaacacctccctccctactatactccaccctatgtacttcatggcaagttccttcccacatttcttctcaaggaaacagatagtagccatggcccagtaattatagttttcaaaatcagtgccaggaaaccataccagcactaaggaagggaaagaagacataaaactaggaaataaaaggccttcctcaatttttctgtgtactcccaaaccaaattactaatcatttttccaacaattaacagaagaaataagttacatatgtttcctcagataaaagttatataagtggagggtgggctttgagaaactgaaaaagaaaaaccaggaagaataactagattctacctccaatacagggcgattttggaatcattctttgctattggttcaaagaactaatttttttttttttttttgagacaggttctcacttcatcacccaggctggagtgcagtggctcaatattagctcactgcagccttgacctcctagattcaagcaatcctcctgtctcagccccctaagtagctgagactactgtgctagccaccactcccatctaattttttgttttttgtattttttgtatagatgggttttcgccatgttgcccaagctggtctcgaactcctgggttcaagcaacccacctaccttggcctcccaaaatgcaatgattacagccttgagccaccacacctggcacagaaccaacatttttaatattaagcgtttcacatagtcagtctttgatacaacacttctacctttgagaaactaagtcatattttcaaaaaagtaggctggctgggagcggtgtctcatgcctgtaatcccagcactttgggaggccaaggtaggaggactgcttgagcccgggagtttgataccagcctgggcaacatggtgagacccccgtctctacaaaaaaaataaaaaattagctggctgttgtggcatgtgcctatagttccagctacctgggaggccgaggtgggaggatcagttgagcccaggaggttggggctgcagtgagctatgatcgcactactgcactccaacctgggtgacagagcaagaccctgtctcaataaaagaattaaaaataaattaaaggccaggcgcagtggcccatacgtgtaatcccagcactttgggaggctgaggtgggcgaattgcttcagctcaagagttcaagaccagcctgggcaatatggcaaaaccccttctctacgaaaaatacaaaaaattagccgggagtggtggtgtgtgcctgtggtcccagctactcgggaggctaagttggaaggattgcttgagcccaggaggtcaggaggtcgaggctgcagtgagctgagattgcaccactgcactccagcctgggtaacagagtgaaatactgtctcaaaaaataaataggtaaaaatttaaaaattaattaattaaaaatgaaaaataaatgtagaaatcagagaaagctttacaaaggagatgactttttttttttttttttttttttgagacagagtcttgctctatcacccaggctggagtgcagtagcacaatcttggctcactgcaacctctgcctcccgggttcaagtgattctcctgcctcagcctcccgagtagctgggattacaggcacccacaatcatgcccggctaatttctgtattttcagttgagacgaggtttcaccatgttggccaggttggtcttgaactcctgacctcaggtgatctgcccgcctcagcctcccaaagtgctggaattacaggtgtgagccaccacacttggacaatcttggacttaaaaaaaatctttttttttaaggctcagggactcactaggaattttgtcctagctgtgtgatcataggcaagtcatttgagttctctgaatcacaatattctcttctgcaaaatgtcttcctgcttacctggtgagaatcaaatgtttgtgcaactgcgttataatgcatatatatagatatatagatgacaaaatataattaacaaagaaagtactggccgggcatggtggctcacacctgtaatcccagcactttgggaggccaaggtgggcagatcacccgaggtcaggagttcaagaccagcctgaccaacatggagaaaccctgtctctactaaaaatacaaaataagccaggcgtggcggcgcatgcctgtaatcccagctacttgggaggctgaggcaggagaatcgcttgaacctgggaggtggaggttgcggtgagccgagatcgccccattgcactccagcctggacgacaagagcaaaactccatctcaaaaaaaagaaagtactgatctggcacagtggctcatgcctgtcatcccaacactttggaaggtcgaggtaggaggatcactagagcccaagagttagagaccagactgggcaacatagcaagacccccatatctacaaaaaacttaaaattaactaggcatggtggtagtcccagttcctcaggaggctgaggccgagggttgcttgagcccaagagtcagagactgcagtgaactgatcgcacgacagcactccagcctgggcaagagagaggcccatctcttaaaaaaattaattcattttttcaaaaggcattgatggatctagaaaaataaataaatgttttaaaattttttcttagaaaagaaagtattattaattgtcagtctggataaaaaaatagaaacttgttttaatgtagaatttctttccctcagtcatgaacaccacatttccttcatttgttccttctcataatcaaaaatcatctttgccactcaggggagtgatctgggctgttttggctctcagaaaagcttttatttgtttgagacaattcttggactaagaattttgacagtatattaaactgcccactaggtggcagagctgagtcaactgtatttctgaattgtgtaagaaataatttctcagaaaaggggaagttgggttgagcacacaatgtcccatctccctcatacttataaacaccaacgcagtccaattttcttctcacagaaaaacaaaccaccacctctcgcctccttaccgtccctgctctgatacatatttgggccacaggctttgaggagggacaaatatgatacagtttagcataagaaactgaggttgaggtgtcaagtctaatagtaataagaaataatactaggatctgaattactggtatattctatccagagacataacccaatctatcaattcaatcaatctatctctatatgtatgtgtgtgtctgtgtgtgtgtgtgtgtgtgtgtgtgtgtgtgtgtgtgtgtatatatatatatattttttttttttttttttttttttgacatggcaattcaagccatcctcccacctcagccttccgaggagctgggactacaggcgtgcaccatcacacacagctaattttttttatttttagtagagacagggtttccccatgttgcccaggctggtctcgaagttgtgagctcaagtgatccgcctgcctcagcctcccaaaatgctgggattacaggcgtgagccactgcacctggcctcaatttatatttaataatacatttattctgtgaagtgtactctaacagatgctaggaagaatacaaagataaaaaagggcatagtttctattctctaggaatttaggagagaaaaggcactttacgtgttagtgctatgtaagaaatataaatgtgctatggagtattccaaagagaatgaaaaaatatttgattgtaaggtaaaagatgaggggattggctgggcatggtggctcatacctataatcccagcactttgagaagctgaggcgggtggatcgcttgagctcaggagttcaagaccagcctaggctacatggtgaaaccctgtctctacaagttttttttttcttttctttcttttttttaagttagccgggtgtggttgcatgcccctgtagtcccagctactcgggaggctgaggtgggaggattgtttgaacctgggagatcgaggctacagtgagccatgatagcaccactgtactccagcctgggtaacagagtgagactctatctaaaaaaaaaaaaaaaagttgaggggattgggaagcaagaaatgtttttggttttgctttgttgctttgagatagagtctcaccctgtcacccaggctggagtgcagcagcatgatctcagctcactgcaacctccacctccggggttcaagcaattctcctgcttcagcctcccgagtagctgggattacaggcacctgccaaccatgtcctgctaatttttgtatttttagtagagatggggtttcaccgtgttggccaggctggtctcaaactcctgacctcaggtgatccacccacctcggcctctcaaagtgctgggattacaggcgtgagccactgcgcccagccaagaaaggtttaatagaggaaaaattatttggctgtctacagaagagtgggtaaaatttcaaaaagcagagatggggaaggacaggcacactaggtacaaggaaaaatgtaagcagggacataaagacagagaaggatatattaagggaacactgagtgctcagttttggctgaagcatagggtacatgtatgaggaaatagtgggaaatgaatgagaaaatttggttgaggacatttcgtgaaggcttaaatgccaggttgaagcatttaaacgtgattcagtaagcaatacattttgcattattataggaacacacaggaactcaattctgtgagattaatctagtgatgttctatagattacagcaggaaaatcagttaaaatctattaaagtaatctaggcaaaagtaacaaaaacatgaaccagaatggtggcagtagaataagaaacaggagacaggtgctagaaacactagaaagatggctctatagaattcagcagttgactggatgtggggcatgacagagaggaaggaattaaaggcaatccctggattttaagcctttataacttggggaatatataatggttctattaaaacaaacaagggggctggaggcagtggctcatatctatgatactagcactttgggaggccaaggtggaatgatcccttgagcccaggagtttgagaccagcctaggcaacaaaatgagatcccatctgtaccaaaaattaaagaattagctgggcatggtggcatatgcctgtggtcctagctacttgggaggctgaggcaggaggatcccttgagagcgggagttcaagattgcagtatgctatgatccctgatcccaccagtgcaatccaacctgtgtgacagagcgagaccttgtctcaaaaagaaagaaagaaaaagaggggaaaaaaaaaggccgggcgcggtggctcacgcctgtaatcccagcactttgggaggccgaggcgggcggatcacctaggtcaggagtttgaaaccagcctcaacatggagaaacccagtctctactaaaaatacaaaattagccgggcgtggtgctgcatgcctgtaatcccagctacttgggaggctgaggcaggagaattgcttgaacctgggaggtggaggttgcggtgagctgagatcacgccattgcactccaacctgggcaacaagagcgaaactccgtctcaaaaaaaaaaacaaggcaaagaaatgggtttgaccaccagggaaagattatgaattcattactagacaagctgaatttgagataacagctggaactttggagacaggctaaaggtatagcatagatttaaagtcatttacacagagtgatgtacagacagtcaaactgaaaagtgaaacttcaagaaagaaaaggagagggcccaggacaagcccttaagaagaattttcagggagtagaaaaaaaaagaattgttagcaaaggagaaaaggatgaagtccaaaagtcaagatttaagtgtttaaaattttaaaacatggcagtttccaaatcatatagaagtcaaaaggaataaagcctataaaaagtactctgactggccgggcgcagtggctaatgcctgtaattccagcactctgggaggccaaggcaggtggatcgcctgaggtcaggagttccagaccagcctggccagcatggtgaaaccccatctctactgaaaatacaaaaattagccgggcgtggtggcacgtgcctgtaatcccagctactcaggaagctgaggcaggagaattgcttgaagccaggaggcggaagttgcagtgagccaagatcgcgccattgcgctccagcctgggcaacagagtgagaccctgtctcaaaaaaaaaaaaaaaacaccctacgttgattttgccaggtatggtggctcatgcctgtaatcccagcacttcgggaggtcgaggtgggcggatcacttgaggtaaggagcttaagacgagcctgaccaacatgacgaaacccggtatctattaaaaatcaaaaattagctgggcgtggtagcacatgtctgtaatcccagctacttgggaggctgaggcaggagaattgcatgaacccaggaggcagaggttgcagtgagccaagatcgcaccaatgcactccagcctgggtgacagagcaagactccatttcaaaaaaaaaggaaaagaaaagaaaaactactccaatttccgctggagaccttgaagaaaatagtttcagagagaccagaaggcagactacaaagggacaagttcagtccacagaaaaagctgatacagattattctcttaagaaatttgacagtaaaagaagaataccgcctgggcacagtggctcacgactgtaatctcaacactttgggaggccaaagtgggtggatcatttaaggctaggagttcgagaccggcttggccaacatggtgaaaccccatctctactaaaaatacaaaaattagtcgggcttggtgatgggcacctgtaaacccagctactcgggaggctgaggcagaagaatcgcttaaacccaggaggcggaggctgcagtgagccgagatcgagccactgcactccagcctgggtgacagactgagactgtctcaaaaaaaaaaatactgtaataacatgagaagggaaataagatatttttatcacatataaaggcaactttaagaactatggcccagcacagtggctcacgcctgtaatcccagcactttgggaggccaaggtgggtggatcacttgaggtcaggcgttcaagaccagcctggccaatgcctgtaatcccaactactctggaggcagaggagaatcgtttgaacctgggaggcagaggttgcagtgagccaagatcgtgccattgcactccagcctgagtgacagagtgagactctatataaaaaataaatagataaagctgggcatggtggctcaaacctgtaatcccagcattttgggaggccaaggcaggtggatcacctgaggtcagaagttcaagaccagcctggccaaaaaggtgaaaccccacctctactaaaaatacaaaaaattagctgggcatggtggtgggtgcctataatcccagctactagggaggctgagacaggtgaatcacttgaacctgggaggtggaggttgcagcgagccgagatcacgccaccgcactccagcctgggtgacagagtaagaccttgtctcaaaagtaaatagataagtaaataaagctaattacaaaaaaaagaaaagaaaaagaactacctttaggaagttattgtaagggccttcagaaaagaaaaaaaaacttttttggtttttttttttgagacggagttttgctcttgttgcccaggctggagtgcaatcttgactcactgcaacctccacctcccaggttcaagctattctcttgcctcagcctcctgagtaactgggattacaggcatgcgccaccacacctggctaattttgtattattagtagagacggggttactccttgttggtcaggctggtctcaaactcctgacctcagttgatctgcctgcctcgacctcccaaaatgctgggattacaggcgtgagccaccacgcccagccaaaaagaactatcttaaatgagcctacaatacctccaaacaagttaattcagcccctctccccatcttgccatgacattggacaatactgagatctctatcctttgcttatcatggtagaaaaattgatctcagtaaacacgaaatgtgggcctccagatgagatatttttaaaagttaaaactaaattaacaaacaagattggacatggtggctcatatctataattccagcactttgggaggccaaggtgggtggatagcttgagcccaggtgttccagaccagcccaggcaacatggcaagactccatctctaccaaaatatatgaaaattagcccggcatgtgcctgtagtcccagctgactcaagaggccaaggtggaaggatcacctcagccctggaggttgaggttacagtgagacatggtcatgtcactgcactccagcctggtgatgaagtaagaccctttctcaaaaaaaaaaaattagctgggtatggtgtgtgttcctagtagttcccgctactgagctatgcttgtgccactgtactccagtctgggcaacaacaaaataaacaaatagataataaagagaatcctgggtttggagagtggctccaccagatactagcttatgtcccaggtcaagtcacttaaccaaaataagaactggttttaaaaaaataaaagactgctacagtcccatttaactctaaaattctctgagtcttgccctgaatcctttattagactattgtgagaatcaaacaagatactgtgtatcaaagcactgagagccaagacaacacatttttatagtacatacttttagacagacatgggcgggttcaagatcttgctctacttacaaaatctgtgacctcaggcaaattacttcacttctgagcctgactgaaccaacaccgagtcacaaggttattgagagaattaaatgaaacaatctaacctcaaatactttctttttttttttttttgagacggagtctcgctctgtcgcccaggcgggagtgcagtggcgcaatctcggctcactgcaaactccgcctcccgggttcacgccattctcctgcctcagcctcccgagtagctgggactacaggcgcccaccatcacgcccggctaattttttttgtatttttagtagagacggggtttcaccgtgttagccaggatggtctcgatctcctgacctcgtgatccgcccgcctcggcctcccaaagtgctgggattacaagcgtgagccaccgcgcccggccaacctcaaatactttctagaacaacatgacagatgacagataattatcactgacataattatataaaagacttggttcattataggtgctcaataaatggcaattacttaaaaagtcacttggaactctaacatgctatacaatttcttttttttttttttgagatggagtctcactttgtcgcccaggctggagtgcagtggcgagatctcggctcactgcaagctccacctcccaggttcacgccattctcctgcctcagcctcccgagtagctgggactataggcgcctgccaccacacccggctaattttttgtatttttagtagagacggggtttcactgtgttagccaggatggtctcaatctcctgacctcgtgatttgcctgcctcagcctcccaaagtgctgggattacaggcgtgagccaccgcgcccagcctttttttttttttttttttaaagagagatggggtctcactacaatgcccagggtgatcttcttgaattcctggcctcaagtgatcttcccatttcagcctcccaaagtgctgggattacaggcatgagccaccacacctggcttacaattgttaatttattcttattgatctatgacttggggcagtcttcaaactcttaatttgcctctaaattccttagggaaaaaattgaaagggaaaagggtgcctataatcccagcactttgggaggccgaggtaggcggactgcttgagcaggagtttgagaccagcctggccaacatggtgaaaccccatctctaccaaaaatacaaaaattacctaggcgtggtggagcacatctgtagtcccagctactcgggaggctgaggtgggagaatcacttgagcctgggatgcggaggtttcagtgagccaagtgacactgcattccaacctggttgagagtgagaccctatgtggaaaaaaaaaaagagagagagaaaggaaaatgggtaagggtaaaagggaagtttacagagtagaggtgagagaagtgattaaaaggaccaagaaagggctttgttctgcattaagaactatgagtcttcatgttctaaatgtttgtcaggccagaggttaaagaaaagagaaatgcaatcagtgtcttgtctctgactggcaacaaagtgctgagggcacttccctccctgaaactgctggctttattctgtcacctgcagtaaagcaaacaaacaacaatcaccacttggtttcctgttggcactgggactgaagagggtagagaaggggcagataaagatgatccaacttgcaaaactctttgactgtgccctactttgctgttcctccttggcccaccccttttcccaaacctcacaagtgtttttataccctgattttaggacaagagtttacaaaatttctttcttcttagacccaagaactgggaaaggagaatcggggcaggtttttatcagaataccaggttacaaggtgaaaggtcgtaaacaaccgtgtccaggaggactccacttcagaacatgccttggctacaggcctggtaggcagcagctgctgccaaagctaaataattttttggcatttaaaggaacccaggcataacacagagcaacgtagtctgtagtgagctctgcaaatgggaagatacaaggaaaccagagcccagaagagaaacttagaacgagagaattgtcataggattttttaaaactcagcaattcagtacttcagagatgtgcccacataaatatcaaataaattgaaagggaaaagggtgcctataatcccagcactttgggaggccaggtaggcggactgcttgagcaggagtttgagaccagcctggccaacatggtgaaaccccatctctaccaaaaatacaaaaattacctaggcgtggtggagcacatctgtagtcccggctactcgggaggctgaggtgggagaatcacttgagcctgggatgtggaggtttcagtgagccaagtgacactgcattccaacctggttgagagttggatgtcttaagatgtcccatattaccaccaccctgatccatcactagccaccatctttcctattccctcaaaatgtatgtagttaagatttaacaatatttaacaatattgactatgtagttaacaatattgattcatatatttgtcagcattttgatgtttgatagttacactttcatacccatcaaactaaacgttctcccagaagccacaattttgaacttttaaaattacttcagtcaggccaggcacggtggctcacgcctgtaatcccagcactttgggaggccaaggcgggtggatcacctgaggtcaggaggagttcaagaccatcttgggcaacatggtgaaaccccatctctactaaaaatacaaaaattagctgggcgtggtgatgcatgcctgtaatgccaggtactcaggaggctgaggcggagaatcgctctaacccaggaggcagaggttgcagtgagctggggtcaggccactgcactccagcctaggcaacagagcaagattccaccttaaaaaaaaaaattacttcagtcagagttccacctcctctgctcccagtaactcaatcaatattgttaaccaactgaaaacacctcaagcctagctggttaagtttctagaacagggtgccgcctcaaacacaccctaaggatcaacatgttcctggggtttaatgcatgtgtgtgttttcgaagagactcatgatgcctattcttgagcttgcttaatattggggttgagttgtaactctcgttagccttagagtgtcaatccagctaggctgtctgaggaaggaagaaggctctttaacagcaatgaataggtttttttttttttttttgctgattgggtagggtttcaatatacttgaatgcttcttaattacctccccatctcaatcttgggacattatcttcctctttccagcacaaggaattaaataataatcttctgataccccagcacagatataggaagggtctatgaatcaaataaaaggaggaagaatccctgcacttttgcatacaggtttttcctattacatttaagagtaagttctcagtactcagctcctaaagcatctcacagccagcaggggaaaatccatctgacagctggccaaacgaaaccaacaaagaatgaagagagagggtagggtctcttctggcttgaatttatagtgctctgttgaccgatctttcttctcttttccttcttactgttttctaaaccgtttagggaaaaacctttgaaaatagtttttaaaattgttccttcaaacaggtgtgtggccatctctccactgaaaatttggatataaacaagaggactttctcacttttaaccagatttatggatgtacatttgatttagtgagttggaagaggggatggagacaagaaagagtgaacataactggaaaaaagtgaaaagagtgaagcatcctttttttcccgcttttccttttcctccagaagcaggtaggaagtgggagataatgagcgcctggacacacctcactaaagaggtaatgaggtaaatggggaacacagacaaagtgttccccaactttgcaggtagaaattgaagagatgacaggataagcaacaggatgtaaacacgcccctcctatttccgttccacagaacagagagaacagaagagagggtacaagctgggggtgggtgacgaacagcacaggcacgcagcccccagccctagccccaagggattggaacgggaaggagaagacatcggtcctacacacacaatgaggcctgaaagttctcctttccctcagagacggtggtgttttttatacttaatagggatgcggggcaagagaaggacaaagggctgttcctgaacagtaacaccaagcattctgcgctccacagccccaaacctgaaagtattcttggagctatgggattttcacacacttgctatttatgagccaggaataacgacaggctctaaagtaactgcactggctaagactaggcatgaaattccctcataagcacattttccttttacctcaaaacaccgctctcagaccagaaacgtccacacccgccctccgatggcctgtcgccctggctaggttttagggtcagtgggatcctccttccactggacccgggagaagacgctcaacagccccctccttcccctccttcctctccttcctctccttcccccctccctgcgccgctccagagcgcaacaaccattttcccagccaggagcacaccgtgtccacgcgccacagcgatctcactgattggtcgggctcctggtaaacaaggaccgggcagccaatgggagggatgtgcacgagggcagcacgagcctccgggccagcgctcgcgtggctcttctggcccgggctactatatagagacgtttccgcctcctgcttgaaactaacccctctttttctccaaaggagtgcttgtggagatcggatcttttctccagcaattgggggaaagaaggctttttctctgacttcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggtaaatatcagctaaatgcatctttgaacttttctgtctaaaatatcttgccctcctttgatcacttactgttcttggagagcgttttaaaattttcattttcttgacacaggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtaaaatcctagtgcttatggcagttaaaacaggaactgggtttaggggcaagggcatgggactggggtagaggaagtgtcattaactatactgagtatcagtaagttttcatctttctcattgctaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactggtgggtagatgcagggtggcttcagcagagaaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaaggtgagccagacctaatgtcttttctttgtttctggtctacctgggtttgtaaaattgtgatggtccagcatttcttgggcaggattcttatgtggccatattttcttttctagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtgaggattgtcatctttactgttaaatttgtcctaagctttctataagaagttgacttagacggattgctaaactggtttgttctttttgttcttacctgaactgaaatagtctgtttctttctttaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttaagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgccgaaccctgtgttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaaaatgtctgtgagatggctttggaaaagtttttggaaagaaggtgtgtctaaaggagttttcctctacttaacaatccacactaatgaaaaccttgtggagaaaacactccctatggaccctaaggaatgtcggcagagtgggggctagaaggtgaagagggaaaccgtttgaggcatgtttcagattcactgaacaactatactgggattttccggttgtctaaactagttttccaaatccataggtaatcattactaaattccttcagttttggagttcatgggttcttgaaatacagggagatgatgtttatgagggcatttgaaagaaaagagtggcggttcctttttttgagacagtctcactcacccaggctggagtgtagtatgatcttagctcactgcagccttgatttcctgggctcaagtgatcttcccatctccgcctcccacatagctgggctacaggcatacacaactacgttcagttaattgtgtgtgcgtgtgtgtgtgtgtatgtgtttgttttttctacgctcagctaattttttgattatttgtagagttcgggttttgccatgttgtccaggttggcctcaaacttctgggctcaagtgatctgctggccctggcctcccaaagagttgggaatacaggcgtgagacaccacactcagctgaagatcccctttttacaatatggttttatcatagggtttcttcccaatgtaaacttgatttatatactaacaaggataacttcaggacttaagaggttatagagttatgagtattaaattctttggaggcagctaaccattttttattttcacagttcctaaccaagcacataactcagtaaatgtttgctaactattcaacttcaccctcatcccttagatgatttgatggttcctattccttgtagggtaatagtagtagagtaataccacaatcccatgtttaattggtgtgattttctttctttctttctttctttttttttttttgagatagagtcttgctctgtctcccaggctggagtgcagtggcccaatcttggcttaatacaatgtccgcctcccaggttcaagcgattctgctacctcagactcttgagtagttgggattacaggcatgagccaccacactcagctaatttttgtatttttagtagagacggggtttcaccatgttggccaggctggtctcgaactcctgacttcccgtgattcacccgcctcagcctcctaaagtgctgggattacaggtgtgagccatggcgcccagcagtgattttcattcctaaagaaccgacaggtggagaaaccctgggatggccaatttaaatatttgcacagatctggtcctggtccttatttgggaattgatttttctgaggacttccacaaactaattccaaataacaggctcctggaaattctacatgaaatcagtgtggggtgttgtagctctagctactcacaaggctgaggcaagaggatcattcaagcccagaagttctaggttacagtgagctatgattgcaccacttgcactccagcctgggggacagattttgtctcaaaaataaataaataataagcaaactaaaatcaatgtgaatttaacagaaagtgagatttaaaagatccttttccatttcaatcctcatttttcgtttatctttcattttccatagcactctcctccctctctttgtctctctttcattaccaaagtgtcagtctctatttctccctattgccagggtgactttcacctgaactctccgcccctttctcacctgtgcaagaatttagtggctcctctccttcaaatctgtgaccaggaaattaggtcaaagttgatggaaaagttttttctgtagcttgttttccagggcctagaggggtgaagcaatgataagagcaggccagagagcaggacaaaggaatggagagaccatggagtacatgagcctggttgtgtgcacagttgggctaccagtacccaatatgagaagagggatggcttcgaaaggatagataactttatacccaaggcctcttagagatctgatcctagggccaggcgcggtggcttacgcctgtaattgcagctactcgggaggctgaggaaggagaatcacttgaacccaggaggtggaggttgcagtgagcccagactgcaccactgcactccagcctgggcgacagagcaagactgtctccaaaaaaaaaaaaagagctctgatcctggaagggccagaacatgggcatctcctccggatacccttaatatcctttatccagctgtccaaatagaactttctatgatgatggaaattttcaatacagtagccactagccctgaaatgtggctactatgactgataaactgattttttttcttatctttttttttttttttttagatagggtctcattctgtctcccaggctggagtgcagtggcacaatcttggctcactgcagttttgacctcccaagctcaggtgattctcccacctcagcctcccaagtagctagaactacaggcacatgccaccatgcccagctaattttttctattttttgtagagacagggtttcaccatgttgcccaggctggtcttgaactcctaggctcaagcaatctgcccacttcagcctcccaaagtgctgtgcacacattttttttttttttttaaacagggtcttgctctgtctcccaggctggagtgcagtggcatgatctctgctcactgcagcctccacctctcagggtcaagtgatttcccatctcagccccctagtagctggaactacaggtgcatggcaccaagcccgactaatttttgtatttttcatagagatgaagttttgccatgttgcccaggctggtctcaaaactcctgggctcaagtgatcctcccacctcagcctcccaaagtgctaggattacaggtgtgagccactgtgcccagcctgtaactgaatttttaattttgtttaattatttatttattattattattattttttgagatggagtttctctcttgttgcccaggctggagtgcaatggcgtgatctcggctcactgcaacctccacctcctgggttcagcgattctcctgcctcagcctcccaagtagctgggattacaggcatgcgttaccacacctggctaattttgtatttttagtagagatggggtttctccatgttggtcaggctggtcttgaactcccgacctcaggtgatctgcccatctcagcctcccaaagtgctgggattactgtgcccggcccaattttgttcaattcaattaaactttagctttctgtgactagtgactgtcacatatgtgactagtgactagtgactagtgactgccatattgaataccacatcaaaatctaagggagtaagcagctagagctgttcccccagaggaaacctatccttctcttacagcacaaaaactccactctacttctttttgccttgtgtatacaacttctacctcacccgaggacattttccgcgtacaggcttgcttcagtacacttccttggggagtggcttagctatttccccacttaagtgggggaatattctgggtcttctttgcctatcctcttctcatgtgccttttaatttttaagtagctatgacctacatgtacaatgattagaggagatgtggttctgagtatcatttattcagtaggtttaatctggtatagggagatctgagagaactaaaaaagaaaactacctaaagagagaaaagggcaagaaaataaaattaacaagaaaaaggggccgggtgctgtggctcatgcctgtaatctcagcattttgggaggccaaggtgggtggatcatttgaggtcaggagtttgagaccagcctggccaacatggtgaaaccccgcctctactaaaaatataaaaaattagccaggcgtggcaggcacctgtagtcccagctacttgggaggctgaggcaggagaatcacttgaacctgggaggcagacattgcagtgagccaagatcacgccactgcactccagcctgggagacagagagagactccttctcaaaacaaaacaaaacgaaaaacaggtacttcaacaaccagagtcattggctgccttgattgatacctctgaacagactggaaacacaaggatctaacttgggttgaggcactgggaaggaaaaatgtggaggggaggatctgacaaagcacatgttcagcaaaaaacaatcacacaagagctgaagggcatgaagtggagtcaaggagtgacctttgcacaattcttttttctctttttgagagagggtctcactatgttgcccaggttggagtggagtggctattcacaggcacaatcatagcaaactctgaccttgaactcatagcctcaagggattccccctactcaacctcccatgtagctgggactacaggcacacgcaaccttggcccaattctttcaacagactacagatccctcttagaattattttcttgggctacctctaggtgataaaatgcataaggtgaataaggaaaatattttactgaccttccaatgatcacaagtccctgcccccaggcatcctggcctcaatagtttggggatgggggaatgggaagtttttttgtcctttctctgttgtgacctcacatcgacctccatttcataagctgaaacactccttttcagagagctaaagatccagggctgcaggtcctggcacaataggtaagtctagaacccagaaaaagtccaaagattagtcttcctatactattaagaaaaaataggccgggcacggtggctcacgcctgtaatcccagcactttgggagccgaggtgggcggatcacctgaggtcaggagttcgagaccagcctggccaacatggtgaaaccccatctctactaaaaatacaaaaaattagccaagtgaggtggtgcgcacctgcagtcccaactacttgggaggctgaggcaggagaattgcttgaaccccagagagggaggttgcagtgagcagagatcatgccactgcactccagcacctgggtgacagagcgagactctgtcccaaaaaaaaaaaaaaaaaaaagaaagaaaagaaaaggaaaaggaagaaaaaatagcatagtatagtagttaagcacgtggacactgaagccaaactatctaaattaagatcttacttctaccatttaaccagctatgtgaccttgggcaacttgtttaaacctctctatgtaacagtttgtttatttataaaatgagagataataataatgcctacctcagaagattgtgagaaatttaaaaatatatgtaaaatttagaacaatgccacataagtgattgttatctaaaataaaagaagagacatatccctcattacccccctgattaatttactttctttctttctttttcttttttttttttttttgagacagagtctcactccatcacccaggctagagtggagtggggcgatctcagcaacctcctcctcctgggttcaagcaattatctcgccccagccacccaagtagctgggattacaggcatgcaccaccatgtctggctgatttttttatttttagctgaggtgaggtttcaccatgttatccaggctggtctcgaactccagacagctcgactcaagctatccgcctgcctcggcctcccaaagtgcttggattacaggagtgagccacagcacccacttagcctcagggtgttctttttcacacttccagtgtgcttcacaagcctgtggattaaaccctgtaaccttctaaaaattatttgaactttcttaacttttcagtacacaactccaaagaaaagcttcccaccatttggagtgataaactgaggaacagagagtgctggatatacaatgtgatgccacaggtcttccagactttttctttcaaggtattgcattccatttgatttttctgtggggtggactagactgaggagcacaaaggtcaatggaggtgagtccacggatgaggcccagtttagcctatttaggctattcttgttctgtcccgacctttccctttgcttgacccttccctactctctgctgggcctgttatgtaaggagaaaagaatgaacagactttgactatcaattgattggtcatctccaggcaacagagtgatgggagaaagaagacagggaaaacaaaggtacaggattgtgaattccatgtgccctgagtcctgagatgttaggcaacgtccattctcagtccttgttgggctatgaagttgctgacaatcaaagttaatcaaatggtcagtaaacaggttcttggaaatgtctggctaggttcccagcttggatatttttaacctcctggacagatggatagaacaaggatttcagctgctgagaggggaggaggtattcaggggcataagaactgtgcttcctttttttttttttttttttttttttttttttttaagagatgagtcgcactctgtcaccaggctggagtgcaatggcgcaatctcggctcactgcacctctgcctcccgggttcaagtgattctcctgtttcagcctcctgagtagctgggattatagatgctcacgaccacgcctgtctaatttttgtatttctagtagatacggggtttcactatagatccgcctgccttggccacccaaagtgctgggatcacaggcgtgagccaccgcgcctggccaacatttgtgcttcccttatatggttctgtggctaaagatccctccctctccacttcagattctgacttcctccttcatctagccagactcagggttaatcctttgtttcctgctctcccatttctctttattccctgtctttcatgcttgcttcaccttccaactctgaggaaactctggtttctgttttacctctggattcctgtagatcaggaagagggtggttgggcaggggccaatggctcctttgtttcccctggagataggtgtagctctgccagtagtactcagaggcttctctgcagttctatctcctcaagctgtcccgcaggacagcttcaaactctcctgcaaactcatgcatcccactgcccccaactcttgggaacagaatttgacaccctgcaagcccaggcctgtgcttcacatacttttggaaagtagaagaaatgatcgtgaaggtcagagaggttggaaatggtgaccaagtctgacaaggcaagatctgctatctctggtttgggaaaattaggtcacctggaaggtggaagggctgggagagaggtcgatcattagcaagttcagaatatctttttgactgtgagggaggcctggaggttaggaatgaaagtgaggaaggagagacaaaaattatgataattccctatttggggtttcatcttcccctggtgaataccctttaaactgaatacccttctatatccaaagactgctttcttctttcctcttgttctttcctgtatctcaacaccatttctgatagtgcccaccctgctttgtggttggaggagaaaatccctgacacaagtgctccaagattgacgggaagctggtggggagatggacttaggtagggaagggagatcacactgtgattcatgtttctcttcttttgtcttgattttagctgatgatgaacctaagcaaagctggaggaaacactaagccagaggcagcaaatcaggggcccataggccaaaccagcttgcagacatttagaaacccatatttccggctgggtgcggtggctcacacctgtaatctcagcactttgagagtctgaggcaggcaaatcacctgaggtcaggagttagagatcagcctgaccaacacggcgaaaccccatctctactaaaaatacaaattagttgggcatggtggtgcaggcctgtaatcccagctagtcaggaggcggaggcaggggaattgcttgaacttgggaggcggaggttgcagttagccgagatcgcaccattgcactccagcctgtgcaacaagagtgaaactctgtctcaaaaaaaattaaaaataaataaataaataaataaacctgtatttcctttcctaaacatttgaatcggttgtaaacatttaaaaatcagatttcactaacatctaccgttctggtgtctcttaaaaagcaatcatatttggtaacactgagtcacattctttcatggcattaatcagctggagctgaaggggctagacaggctctggtttgccagttctcaccactccctattgcattacactcacatgcttcgatcttttatatctgcctgactcctgtttagtgtttaggtttgtcttagtttgttacctctgctctaagtagagcttctcaaatatttcttctgcaggacccctaagatacaagagagtgaaccattttcccccaggactcccaaagcagtctaaagtagcctgtcataagccagaaatgtctttgaagtacctattttctttaaaaaatgcaaattttgatttacactgcataatatatttgtgttggttttagcataaaaatgatttatcttcccccaccaaatcttaaaagtaaaattaacactctggaagatgtgccatgtgtattctgtggctccaaatagtcttcaccatatcaccctaggaataatccaatttaaacagcactgtataaaggcatgaggtaaagagagacatggagaaaagacacagagaaagagtcaaaaagaggaaaagaatttgaaaaacaacaagaatgagtctgagtgacaagctttctgtctggtcctcagccaaccctccaggcctggcccagtccagccactgagaagtgtataaacatccctgatatctctggacaggtgttagtgtggcggctcagggtagaaagcaagacccaaaacaggagccaagccaagtaagggagaggtgagggatccagagcagccaagtatggtcagatgagaaagattgtctaggtgtgccaggaaagaggcttggaaaggaaatggaagacttagaaaagggctgatcagcatttgccctttctcccactgagcccattttgtgtcacttcctcttatcactctgcctaagaaaaatgaggtacaagcattaaattgtcctcctttgaagagggaatttcttctccaaaatggctacatctctggtcataccagagcctaaggaggatgagtaccagggcttctttccctgtccaaatgggactctacctattctctccaagacaggaaatacctcaaatccacatccctaacttaggtgagtttcttccacctaccccttttggtaagacaaaaataggtctaactccctccctcctaatctaatattatcagcactgccctgagtgtaccaaagaatatcagagacaggatttggatattttccccctttctctactgtaaaccaggatcaatgtggaatcacaaggatgggaactattcaggaaagggctgggagcacagcccaaagctgaggatcctgggaggaggagaggtttgagaatggagaataatcccagactctgaggtcgtggggacctagccccttcctgcattggttgggatcaggcctaaggaatctctggattccttccccagcatcttgacatcttggattcccaaggtgagagcacctagccattacggtcccgcagttaagctggatcattgtcttcccactgacccccattaaggttatgagggggacctcccttctttcctagatacaaagaggcaaattaaagtctattggagatgagccaaaggcctttctgaggtgatagcaggaaactggaacttatttccagttttgtggtcccaaatgaccttgaggaaatgtgagccccagaaggggaaaggtcagtggagaagaggtcactactggtttggccagattagttagtggagctattctcgttgagctcatttctcttctccatcctctggctggacatgacatacgaggggagatgaagaggacatgcccaccagccccttcttcagtcagaaatctactggtggcctgtttgatttgagtcctggcttgcagattgtgaccttgaactctgctgtaggtggtgtccctttcttgctagttgatggaattgttgatcttcttgctacccaagctgaagcaggttcttggaaacgactggccagatgcctgaggtatctttagtctgcctaggctgaaaataaagtggggaaatccagcgaatggaatgtgttcagccaaagctaggcacatcctgcctttgttctcaggcccatttgaattcttacagatggatcagcataagccctactatgtgagagctagaagggctcccagtggacacatctagtccaaatttatatttcacacatgaggaatactgaggagtggagacatacatgactttctgaagggcacgaagctatggagtggtgaaactaggaccacaaaatagtgtgaaacactgtctcttaaaaaaagtgaattgaggaaaagaactgtctgttccttaccaaattataggtgcccaattaccttattcatctgaccctccaattttctttggtctccactcccaatctaaactacatgttgcttccaggtctgccatttagcctccctcaaaccacttgagtcactgaggctgtctgcagacccctcttaaactgcccacctgagatgggagaaaaatcatgaggctagggatggaacatagcatagagaaaaataggactctttcccttttttttttttgtagaggcagacttagggaagactatgttgccccaagctggtcttgaactactcgcctcaagcaacctcccacctcagcctccaaaagctgtgggattacaggtgggagccaccatgcccaggataggattcttgacagagaacctaccctgcctggggccagtgcagcccaggctgtggacatggcagcaatctgttcaacataagccctatcaggcgagtagtactgggctgagcagcactgtgtaagtcctctgtaaatgtttgcaagcaggcgctgggcacggtggctcacgcctgtaatcccagcactttgggaggccaaggcaggcagatcacaaggtcaggagttcgaaccagcctgaccaacatggtgaaaccccgtctctgctaaaaatataaaaattagctgggcatggtggcgtgcgcctgtaatctcagctactcaggaggctggggcagcagaatcacttgaatccaggaggcagaggttgcagtgagctgagatcgtgccactgcactccagcctgggcaacagagtgagactccatttcaaaaaacaaaacaagacaaaacaaaaaaagtttgcaagtatggcctcaagccctaacctctcaggggttcttccaaagtgaataggagccgtgaccctgtttactaggtcttgggcttcaggcctgcctgatagtacctatggaaagtaggggaaaggttgatggaaacaagtctagctcatgcctggaaccacttcagaatctgggaaagctgctgggtcctgtgtccctggctttgtccagcaaggtcacctgcagacagggcagagtccaagaatagtctgatcttcctgacactttgaagtaatacaactgatctcaagtggtcactccaacctttgtcctcatttccccagtttcatgggaaaaggatgtgtgtgcataggatgtgtgctgcttttccagaatcttctttgttcccactcttttaagttcccaggctgacattgtgggctttatggggtggctatgctcccaacacagacacatatagttgaccaggttaggacttggtgtgtgtatgtagggaacaatgcaaaaggaaaattttcaatagcttttacttttgtttttgctgatctctccctagctataatcacaggctgaagtacagctatgggaaacccgttacaggtcccctatttccttcctgccactcaacacaacacctcaggaggactaaaaaaaaaaacacatcaatcatcataaattgctcaatgactctagaatgttctgtttctattcctgtttccttcactgcttctactcttttcttcttttcttagaggcgggttcttgctttgttgcccaggctggtggtgcaatcatatagctcaccgcagcctcaaactccagggctctagggatcctcctgccttagcctccctagtagctgggactactagggagtgccaccacgctcagctatttgaaatattttaaaatatttttgttgtagagacagggactcgctttgttgcctagactggtctcaaactcctggcttcaagcaatcctcttgcctcagtcttccaaacttctgggattacaggcttgagccatggcacctgccattgcttctatgtaaacactaactaacacacccaaactaggcttttaaggtgctttccctcaatggagtcacagtctttcttcattctttacaatggggtcagacatattcaaccttagattgacagtctctatcacttgatgctgtagggaattcagtcggcctgcctgaatgcagttggggaattttttgaaggttcttctataccccatcttacggctttcaaatgctcagcagggttgctatgatagcatgccttcttattcagttcctattctggacacgcagcttgcccgtgactgttgcatgtcaagtggctggaaccaatcagcttatctaaggcttcctcagaagccaatcagagcctcggaaagtgacctcacccaagggagagctctgtgggcgagaaagcatctctcagatctgtgagtgtccctaagtcactcccttcctccccaccctccttacttcctgtaaaacaacaccacaccgcctacctcccttcccccaaagaaagggagtgagaaaggctaactaaattccacaaagggaagaaccaaaagagaaactgcaactcagccacacactggtttctgtaactggagaacaggatatttagggggacttgctctgcacagacatacctttcaaagtggcatctccagagtctggaagaggagggagtatggtgaataagtcagctcctcctccctcctcatacctggttttcttgcctttccccacaaaaatagctgtaatcattttttgtaaataaggacaagatcaaggtcaagtgtgggaaagacaggacctatgtccttgtgaacatgtgtgaacagacacaatcatgtccttgtggcctgaggaccagaggctcagaagtcagctgtactgcagggggcgtaggctgttctctacaatttactttgcattgccctacagatgaggccttgaatattccttggctgggctcgattgtgaatatgtgtcccaccatgggggtagaagggaagggacaaaggacaagcgggctgtagggctgtaaccctccagtgtgtcacaccagacccggcttagttaagcatttccttcattcctccagccctctgtcaccaggcctcacccacaacagagagacagataaaaacactttatttaaaagtataaaaccaggcttactccttcaaactgctcccacccctaattatctccacaaagagctatataaattgggcaggggtatgtgtacagtcatctcagctctaacaaccccagttcttctttcaattctcctttctcccttcatacaattgagatgtttgtcctttgcactttccccaagatagcaaaggtgatacaaatgtggaaggaggggaagtgtagaaaataaactgtcatcatcctctattcccatctccagggaacagacagattatatgaactctgaccaaatgatttgcttgtctgaagaaacaaataataggtacagttactctctgtatcctaaagaaagacacgagggtccagagtccttcttcagtatatagcctcgtccatattgtcatcactgtcaccaccaaagtcctctccattgtcaaaatatgacatgatgtaatcagtttcctgaaatggaaaaaaaaaaaaaagtaaaagtcaatttggcattcaccttccttcctgtgtaccagacccctttcctctcagtcacaccattccaggcctgagacatctcttccagctgtagtttgtagaaggggggcagatgaagtagagagaagcccctaccctggggggcactatctctgttggcatgccaaccctctgaggagagcaaccctagtataaagagggtaaagggagggggactaaggtggaaggagtccccttcacctcttcatgttcttcttcatcatactcttcttcttcctcctcttccttctcttcttcttcttctttctcctcatcctcctctgaagttacttcttcttccttcttctccagggtctcatgtggggatgaataggaatagaaactcaggttcagttcacagaagggaaaaattgaggcacacatgggccaagagagagggaatggatccagggctcaggaggtctctatgcacacttcctcctcacctctagtttctgtattgtttcctccttatcttctgtggtcttagggggcctcttggggagcagaattgtaatccctggtggagggatcaaaaggtaaaccttcagagagcaaattttgccagctttatagcccatcctcatgcaaagaacatgtcactctgctgccctcatgtggccactatgacatctagcaacaacacttggtagattgggtataggaactgggatggaaggtgagaccagcagcagcctcggccctcaggctgatgaaggaaacctctcttctccctccttttttccagatacactcacgttccttctgtagcttccgcactcggatctttagctcccggggtagacgccgccaatctgggaatagtgggaacgtaaatgtcaataggaccctgcctggggtctccagtgaatactgactggttttaaaggggggtgagggttttaaaggagaggaaggaaggggctgggccaaagttgttcagtggcttggatatctcctgagtagtgggaactatttaatagctttttcaggtagaatctgagaatgtgttggaccataactaaggctctagcttgcagatgctggatcggggaatggggtggggtcatgggcgtggtgggaatagcttgaagcatcccatgcatttgaaagaagggcagtcaatgaaagggcccatcacctaccagggttccaatcgatggcattgtcaatcggacctgacatctgatatttgtctgaataacgctccacatctgaggggtggaagggtcaaagttttatcccttcagagacccagaacaggactgttcctgagagtccagccctctcaatactgaggaattatctgtttccttaccccaaacccagagcccagggggtcagcttcagtgaggaccttatcacttttttttttttttttttttgagacagagtctcgctctgtccctcaggctggagtgcagtggtacaatctcagcttactgcaacctccacctcccaggttcaagcgattctcctgcctcagtctcctgagtagctgggactacaggcacacaccaccacgcctagctaatttttgtatttttagtagagacggggtttcaccatgttggccaggatggtctcaatctcctgacctcgtgatccacccacctcggcctcccaaagtgctgggattacaggcgtgaattactgcgcccggccccttatcactcttctaacctgttccttttccacccaaaattacgattttttttttttcagacagaatctcgcactgtcgcctgggctggagtgcagtggcgtgatctcagcccactgcaacctccgcctcccaagttcaagcaattcttgcctcagcctcccaagcagctgggattagaggcatctgccaccaggcctggctaatttttttgtattttttgtagagacggggtttcactatgttggccaagctggtcttgaactcctgacctcgtgatctgcccacctcagcctcccaaagtgctgggattctaggtgtgagccaccacacctggccttttttttttgagacagaggtttgctgtgtcacccaggctagagtgcagtggcaagatctcagctcactgcaacctccacctcccaggttcaagcgattctcatgcctcagcctcagcctcagcctcccgagtagctgagaccacaggcacacaccactgtgcctggctaatttttatatttttagtagagacagggtttcaccgtattggctaggctggcctcaaactcctggcctcaagtgatccacccatgtcagcctcccaaagtgctggccattacaggcgtaagccaccgcacccggccatgatgattttttttttttctgtcccttagttcaaaggcatggctgtattaagaaatagcgtggtgcagtggaaagtatgctagggaataagaaaccaggatttcagtattctcttgttggttggtgcttataatatccagattgttaaaaattttgctgggcgcagtggctcatgcctgtaatcccagcactttgggaggccaaggcaggagaatctcttgagcccagaagttcaagaccagcctggacaacataaggacaccctatctctattttacaaaaaaataaaaaatatataattttttagaaaatacatccccctacttatacacgtgaaatgggattttaatatttaacctcctgctgtcccaagactatcatgagactcaaaacaaaccatgaatactataatgcatttcagatacaggggtaactattatgatctccccagttagatagtatgcttcctgtgcccctctggcccccagtggtgctgagcacagggcactccccatggaaggcactcagaatatgatgctagcattccaactgacctctcttggggacagctggccggatgaagtaggggagctgcctcatggctcctcgtagctcttgcttcagtgccaggacatattccccttcctcgcctgagggcaaaggtactgggcggaactccaagggctaaagaggcaggggcagtggtcagttcagggagaaaatgctagtacaaatttaggaagacccctcctcccaatttagtctaacactcccactgagcagagggccaaatgacaatcgagggagtaacatattattttgaaagctggggagaagtaaaggtggacacttctttgcctgcaaaacatccctgtgcattgggagtatagagagagggccaaagcgaggatggttttatgatggtccaggaggaattcagaatcatgtacagtcagccaggggcacatgagagtctgggaagggagtggagagactcacagggaagagtggagaaggctgcagggtgggtgggggcaaagcatcccctttcccaatgcccacggcctccacgttgaaggtcaactggccccggccacgaccccggcccccaccccggctggccatggtggagggggcctgggtattcagagatccagtgaataaacctaataaagacaaaaacaaagagaaaaagaaatgtagtagaatggacaggaagccaaggaggtacaagacattcaatcttttatctctgggacatgaaaagttaatgtcattcaacaaattttgactgagaaggcacagtgtcagagagagaatttctggaaatataaacatgaatgagacatggtcccccaaacaggtcagataattacaatatagtttagcacaaaggagaaagtgctgacacctttggacaaaactctacatccctaagacaatttgatgtttatctctatctgcatttctttatttttatttttagagatgctctgtcacccaggcttgagtgcaatggtgcaatcacagttcactctagcctcgaacccctgggctcaagatcctcctgcctcagcctcccaaagtgctgggattacaggcatgaaccactatgcccagccacaaactgcatttctacatataacctttgaattctttctatctctggccttccaaacctgaccaggccccaattcaatccaatgcaatgcattcggcgaaacatttattaatcgtctaccatgaaaaagatagtgtgtcaggcactgtgggagcacagggatgagtcatcaatttcattgtaaaccaggggaaaagacacattacaatcaaattgatctttttattttattttatttgagatagggtctctttctgtcatccaggctggagtgccgtggtgtgatcatggctcactgcagcctcaacctcctgggctcaggtgatcctcctgccttagcctcccaagtagctggagctacaggtgtgtgccaccatgcctggctcttttttttttttttttttttttaagagactggatttcattatgtcaagtgatccaactgtctcagcctcccaaagtgctgggattacaggcatgagccaccgcgagaggccaaattgatctttttaaacaccacttggaagcatagaatcttagaattgggaggacccttatagaggtcatctagtctaaacccctcccagtgcaggacttcactctgtaaattgttttgttgttgtttggtgtatgtgtgtgtcttctttttttttttcttgagacagagtctcactttgttgcccaggctggagtgcagcagtgcaatcttggctcactgcaacctctgcctcccaggctcaagtgatcctcctgcctcagcttcctgagtagctgggactacaggcatgtgccaccaagcctggctaatttttgtattttttgtagagacaggatttcgccatgtcacccaggctggtctcgaactcctggactcaaatgatccacctgcttgggcttcccaaagtgctgggattacaggtgtgagtcaccacccctgaccctactttgtgaattgttattcagcttttggtggcatttccctaaagagatggtatccattctccccccaagacagtatattccactgtgatcaacactgatgaatctaaagtttctccttctaccgaattttcactctgtctcttatcatcaatcctgaggaaccagtcagaggcagctaggatgggggaataaaatcaccagatgaaaagaaaacttgagagaaatgatatcccagtagcaatgagcacacctagcacccagatcttggtttctcatacaattttccaataaaaggaaccagggctctctggactactagctgattctaggacagggtaggaaatatacaacatgagtctagagcatcttgaggtgccaaaaagtaaggaggtgctcaaaacaacaaccacactcacatattgatgggttagctgggtgcagcggctcattgctataatcccagcactttgagaggctggagcgggcagatcactcgagccctaggagtttgagaccagtctggacaacagggcaaaacctcgtctttacaaaaaatacaaaaattagccaggcatggtggcatgcacccgtggtcactgggtgatccttccctactgggaaggattgcttgagccggggaggttgatgctgcaatgttatgattgcaccacttgcactccaacctgggtggcagagtaaagactctgtctcaaacaaacgaaaaacaaacaaaaaggagaaaaaacgaaaaaaataaacatattgatgaggctatgtcaaagggacataagagccaactgaaaaagttcccaatggccaaagctgaaacaatttgaggaacaaaataaataaagcagtattagattataaccccaaagtataagataaatatctgtgagtccatagtgatataaataaatgactgaatttatttatatgggggaaaaaagacaaatctctcatgtagaattccaaataaaatatgtagacactccatcctaaaagggagcaggggagcataactccccactttttttttttttttttgagatggagtttcgctcttattgcccaggctggagtacaacggcacgatctcggctcgctgcaacctccacctcccgggttcaagagattctcctgcctcagcctcccaagtagctgggattacaggcatgtgccaccacgcccggctaattttgtatttttagtagagacggggtttctccatgttggtcaggctggtctcaaactcccaacctcaggtgacccacccacctcggcctcccaaagtgctgggattcaggcgtgagccaccgcactggctataacttcccacttcttatgtgtggactgtgtatagggaatttctctctctctctctctctatatatatacacacacacacacacacgtatatatatatatatatattttttttttttttttttttttttttttttgagacagagtctcactctgtcacccaggctggagtgcagtggcgcaatctcagctcactgcaacctctgcctcccgggtgcaagcgactctcctgcctcagcctcctgaatagctgggattacgggcgcacgccactacgcccggctaatttttgtatttttagtagagacggggtttcaccatgttggtcagtctggtcttgaactcctgatctcatgatccgcctgcctcggcctcccaaagtgctgggattacaggcgtgagccactgcacccggccctcattcaataatttaggaaatcaggaggaatatctttacagtggagagaccagaaaaacactacttcaaccagatgaccaaggtcagcatcagtactcataaatcatgttttcggtatgtgcccttaaaattacatgataaaatggtacttcacctctgtgatcatcctcctaaaaacccataaccccacactaataaagagaaaaatatcaaattccagcagaaaggcatcctacaatatacccaactcctcaaaactgtcagtcatcaaaaacagtaaagtctgagaaacccgtcacacttaagaggagcctaaggagacgtgacaactaaatataatgtggaatcctaaatgggattcatgtacagaaaaagagcaataggtaaaaaccaaagaaatgtcaatcaagtatcaaccttagttaataataatgtatcagtattcattcattaattgtaacaaatatacgaatcaattttttttttttttttttttttttgagatggagtttcgctcttgttgcccggctggagtgcaatggcgcgatctcggctcactgcaacttccgcctcccaggttcaagcgattctcctgcctcagcctgctgagtacctgggattacaggcatgcgccaccacgcctggctaattttatactttttttagtacagagggggtttctccatgttggtcaggctggtctccacctcccgaccaggtgatccatccgcctcggcctcccaaagtgctagattacaggcatgagccactgcgcccggcatttttttttttttttttttttttttttttgagatggagtttcgctcttgttgcccggctggagtgcaatggcgcgatctcggctcactgcaacctccgcctcccgggttcaagcgattctcctgcctcagcctcccgagtagttgggattacaggagcccgccaccgtgcccggctaatttgtttttgtatttttagtagagacggggtttcaccatcttggccaggttggtctcgaactcctgacctcgtgatccacccgcctcagcctcccaaagtgctgggattacaggcgtgagtcaccgcggccggccaatctacaatgttaataggggaaactgtgcactgggacaaatgggaactcttggcactatctgctaaatttttccgtaagtcttaaattgttctaaaatatataatctattaattaaaacaaaaacaaaaaacaaaaaaaactcgaggctgggcgtggtggttcacacctgtaatcccagcactctgggaggctggggtgggatgactacttaagtccaggagtttgagaccagccggggcaacatagtgagattccatctctacaaaaaataaaaaaattagccaggcatggtggcacatgccagtagtcccagctacgtgggagactgaggtggaaggatcgcttcagcccgggagataagaggattcagtgagccatgatcatgtcactgcactcaccctgggtgacagagaccttgtctcaaaacaaaaagctaaaacaaaaatcaagtagcaattcaaaattcccaagagattagttggtgaaaaaaatatttaaaaataatatgtagaaggtaatcttctgtcagaaatacatacacacatatgaattaaaaatctgttatagaaggatatgtaccaaaaattaacaacggttaatttgaaggatgagggttttttgaattttttctggtggggagagttgtgtatctttttttttttttttttgagacagagtcttgctctgtcacccaggctggagtggtgcagtggtgcaatctcggctcaccgcagcctccaccttacgggttcaagcaattctcctgcctcagcctcctgagtggctgggattacaggcacccaccaccatgcttagctaatttttgtatttttagtagagagggggttttcccatgttggccaggctggtctcaaactcctgacctcgtgatctgcctgcctcagcctcccaaagtgctgggattacaggcatgagccaccatgcccagccaggttatgtatgctttgtttttttctatactgaatagaatactataacaacattaaaatattaatttaaaaatttttggctgggcatggtggctcatgcctgtaatcccaacactttgggaggccgaggcaggtggatcacaaggtcaagggatcgagaacatcctggtcaacatggcaaaaccccgtctctactaaaatacaaaaattagctgggcatggtggtgtgcgcctgtagtcccagctactcaggaagctgaggcaggagaatcgcttgaacccgggaggtggaggttgcagtgagccgagatggcgccactgcactccagactggcaaaagagcgagactgtgtctcaaaaaaatttttttttaatgggccagttgtggtggttcatggaggtaatttcagcactttgggaggccagggcagaaggatcacttgggcccaggcagtcgaggctgcagtgagctatgatcacaccactgtgcaccagtctgggcaacagagtgagaccgtgtctcaataaatagataaataaaatttaaatgtcgtaacagaatactaaatgagattaataatctgtagctaggagagggtagaaaaatgtatatctgaggaatctgggaagtttcaagcccaactgccataaaaaaaattgaggaaacaatggctgttggttaagatatcaaattgcaatctgtttgaaaagagcatattaagggagagaagatgtctcatggagactagagaaataataagaatttgttggctgggcgtggtggctcatgcttgtaatcccagcactttaggaggctgaggtgggcggatcacgaggtcaggagttcaagaccagcctgaccaacaaagtgaaaccccgtctctactaaaaatacaaaaaattagccaggcgtggtggtgcacgcctgtaatcccagctactcaggaggccgaggcaggagaataacttgaaatcaggaggcagaggttgcagtgagccaagattgtgccactgcactccagcctgggcaacagagcgagactctgtctcaaaaaaaaaaaaaaaagaatttgtcaccgtgtcttcagccccttttaagcgagagaacattctaaccagctggttaagtatctttccacttgacagatatagttctggcagtggagataggagctgctgtgactgcaaagcaatgaagagtcaataaatggccatgagtttgaggttagacaaattccacaccatttctacacattaaatgagtgatcctctaagaatgcaggggaaaaagaagacaaaattttatttaatacaggttgggaaataaaccatccatctgccccattcatcttaggaatctatagggagtctctgctattaaagattgtgatggagttaaaattcttgaggatacttaaggtctcccataatctagtcacaatctgctcctccttaacatcaacctttccagagagtttacccctgtactctgttttactccaaacaacactcatatacactatgctcattcccaattattcatacatatatattgtggtggaagttactgagaggcaggtttcaactaaacatacagaaaaacactaacaattacatcaaatttaaggaaggcagtacatgtagaggttaagaatatggttttgaatcccagttcaatttcctagctacaaaactctggtaatttatttattgtctctaaacctgtttcctcatctgtaaaatgggaataaaaataacaataatagaatcatttcactcaacaaatatttactgagtgcttactaggtgtgccaggcactgttctagattctatggatatagcagtgtgcaaaacagacaaaaacatgctgcacccacggggtttaaatggagctttcattccagtggaggcatcagcaaacaaacaatacttcaagccatgagactaggtgagacccctaaaggagtggatgtggacagagaaaataagaaatccaggcactgaggcctggggcacgctgatgtgtagaatttgctatacatgtaataaataaagcaagaaattaacacccttaaaatcttggaaatccaaattttaaaaaatcatctcaatagaaaaaatgggcaaaggacatgaacaggcaactggcaaagagaatggccatgtctggacatggtggctcactcctgtaatccagggttttgggaggccgaggtggacagatcacttgaggccaggagttcatgaccagcctgggcaacatagagaaaccctgtctctactaaaaatacaaaaaattagccaggcacagtggtacacacctttaattccagctactcaggaggctgaggcatgagactcacttgaacacaggaggtggaggttgcagtgagctgagatctcaccactgcactccagcttgggcaacagagcaagactgtctcaaaaaaaaaaaaaaggagagagaatggccaataaaaccactcttcacctatgaaagtgacaaagatttaaataataagcaggctgtcatgagttttttttcaaatggacactctcatacctcactggaaagactataaacataatatttcaaggggagcaatttgtccagttaaatcaacagcctttgaaatgtttatatccctaatccagcaatcccactttaaaaatatattccaaagacatcaacagatatacagtcacagatataagtaaaaggatattcatcaaagagctatttatggtagcaaaaattctgaaataactgaaacaatctaacaataaatgaatggttaaaaaatacccattttatttatttatgttctttttattttattattttttttttgagacagtttcactcttgtcgtccaggctggagtgcaatggcgcaatctcagctcaccgcaacctccacctcctgggttcaagtgattctcctgcctcagccccccgagtagctgggattacaggcatgcgccaccatgcctggctaattttttttgtagttttagtagagatggggtttctccatgttggtcaggctggtcttgtactcctgacttcgtgatccacccgccttggcctcacaaagtgctgggattacaggcatgagccatcacgcccggcctcttttttttttttttttttttgagacaggttcttgctctgtcgcttaggctgaagtgcagtgcagtggcaattttggctcactgcagcctcgacttctccagctcaagcaaccctccacctcagcctcctgagcagctggaactacaggcctgagacaccatgcttggctattttttttgtagtttttgtagagacagggttttgtcatgttgcctagactggtcttgaactcctgggctaaagtgatctgcctacctcagcctcccaaagtgctggaattacaggcatgagccaccacgcccagccagaaatggcttgcttttaagaatgctaccaattccactgtaaaaggacagatttcctttttttttttttttttttttttttgagagggagttttgctcttgttgcccaggctggagtgcaatggtgcgatctgagctcactgcaacctccgcctcctgggttctaatgattctcctgcctcagcctccccagtagctgggattacaggcatgcgccaacacgcccagctaatttttgtatttttagtagagacagagtttctccacgttggtcaggctggtctccaactcccgacctcaggcgatctgcccgcctcggcctcccaaagtgctgggattacaggcatgagccaccgtgcccagccatatttccctcttttacagtggaagtgtggaatgcatttcctttagctatatatttcttatttagaatatttgtaggatattgactaaagaacaggtatcaaaaaattgaatgatctacaagagagataagagagttcccttactaaagatgtttacatagaagctgggtaaaaatttactacatagggtttgtaagaaggatgcatggctctagtagaggattccctatgatcagcatgatttagcattgtgtctggcatatagtaggtgctcaataaatatttattgaatgaataaatacatcatttctatgggcctttccaaacttgagaaattgtgatccataaagcctcccctcaccattccagttctccttgctttcttccttctctagattgtagaaacaattatgaaacactaatattatgaaccactaatttaatggctcttaattacatactgtattgtcttttattgttccctagttatgttaggagtttaaattctgcctccccaaaaagagtgctagttaccagaaatcaattctatttaactaacgtttattgggcactatatattaactactagcacctgtcctacaaaaccttctattctaaaaggcatagaaacgttaaagagagacagtgcactaagtgtcctaataaaggtatatacaaaacgctatcgtagacgggggaacaattcattttgcaagaaaggcggcccaggaaaactacaggtagcatttcagctagtcttcatagataacaggagtttgtcaggctcttgggataatattaatagattagggggaagttgatgctatagcaaagacagatacaagaggctgtctcgttttctgctttaatgtctctccccatgcgcgatagaaaactgccattctctagtatacaatcaatacagaaatggaagcccaggggagaaacggtagggagccagaagggggctgatccaacaacctgacggaaagcgttgtctatttcgcagcctggccggggtgaacaagtttggcaagtgtcggaccgaaccaggtcaagccttacctgctgcccctccccaaagcggagcccaagccgcgaccaacttgaaatgtactgggcttcctcaagtcggtggcgttctaagcccgcctcccggagctccctattggtgagttttctcggccaatgcaggagaagccgaggagggaagtccgccctcttgaagcctaggaagagaaggagggagggagcgagtacgcccggaaccgaagcttgcgaagcgggtcgcagagagagatgggcgttgcagaatcagctggggtcacttatttccggtctcactccagatgaaggagccactagccggcgagagttcaccgagggaacgtgacactcatatctcatcgagggaccgtgttgagggagcccctacagagaggccaaaggaggagagggcctacggagaaatgaacctctgtaaaagctgctctttagggatcagtctttttgtgactctagcttcatagcttggtctctccattactccagccttcctttcaatcatacactgcctctctccagcaccaccaatggatacttcttttctaaaaatgtttttctgtgggttgctgccgtgtctgtgagaaggtgggcagagggttcaagaaaggaaggatttgggatcagcgtaccagggttggggagacagggcaggagcccagctttttctgcattttccactactttccacttcctgcgagctccttgggaaagccagcagagtggaaggaggagtcctattttcacagaaagcagaaacaagggagaaaggttcagaatggagatgaaatctaggagttagtcaagaagaacatcccagatgtcagagaaaatggcctgtagactgggaggctgtaggtgtagtggcaagcgcccagtctttgccataggacagaaacatagctgtgaagctttggagagcttgcttaaccttattaagtctgtttcctcatctgtaacaagaagatgatagttcctatcttataaagttgtgaggattgaaaatagtgtatgtaaagcacatggcacatagttgacacgtgtccaagaaataactagtaaaaatgggtagcttcctgcaaatatttctctctctctcccatccccgggaacattattttcagtatcttgcatctggggggcctccagcctctgaattagctcaggaccctgagtgaactttttaaatccttaggatttttctttttctcccacttcccttggtgccttacagctggacacaaactcattcctaaaatatgtggatggaagctatggtaaccatggagacagggcaggtggcaaggagaggcagagacagtgtgagagaccaatagacagataggaagagagaagatataaggaatgtttcagacagagatcgtcaagcaagatggaaaaaataagacgtctaagcaagactgagattaaagagatgcaatgtgagagagtgtattacaaggttcgctcttcttcctgcccctgtcctatctccctgcccacaataatacggggtggaggcacctggaatgtcccttgccttatctaaaagtgctcccatatccaccttcctcatacttatctaagaggtctacataagggagctgaggtccaagtttctctgcgatgggtgttccgtttttgagagatggggcgggggtgtatctgtgtctgactccaggctggaccgtgatctccttcacaattaaactacaggaagaaagccacatctcttgcctctctttgcacagtatggacaccggctgtggatccaaaaagcctttctacacctttcttacacagtgtgccatgtgccgtgtatggcaggtcaggtctggcgcacaggagcgcacaaacacaccaagtgcggagaatggggatctgctgaatctcagcgaagaatctggatgatggtccctgtctgggtcgcggaggagtcccctaaggaacacttaggtttgttggggctgaggggaggtcggctgagaaaaggaagtcaggattggagcctctaggtttttgagggtttatgtgtgcatgagtgggggagcagtttggtgcctgacgcccccacccgcagtgactaggctataaatagcacagcagagctccgccccccccccccccccccccgccaagcttctctcctcccgagccggcgctgtgcccggggcgctccgggaggagggaccaggatccggcgccggggcgcagatactgacaccaagggaatccgggtgccccccccccccacgccatgcgggcccccaggaaactggctccgccacctcggctgccccgtggccacggccccaatcctggccaggcggagattctgcggacattcaggtatctatctgggcacacagcctgggaggggaaagagcaaggagtgatggggaacatcgcaggggcaatagaaccccccaattctccctccacccgttttaggtctcaaatgcaggctgcttccctccccccactcaatttttggggttgtggcaagctaaaacaggttaggaatgagaatacatgtgtgactgtagggtgcatgtatgtgggtgggtggcgttcagcatcctagaaagggggatcccaagtgtggataagacaagggggacagaggaaaggtctgataagccatggggtgagggtgggggtgcggacatccctgcgcgtgcacgaacgcatttgcacgcgcgctagtccttcagtgcgggtgcacccttcccacctcctcaggcatgcgctgcgggggaagggccggctcaaaggcatgagttagaggaaggactgtatgccgtgaaggtctcctccaccccacgctgggtccctgcatctgtgcctcagttttcctgccgaatctatcaatgagatgtctctcttgcagggatcggcttcgtcactgagacctcaggcctctgccagccactccccctccccatacccctagtcatcctcggcaggtctcagtcccggctccatctgtgccctcgccccagccgcagctatgttgcacaccgagggccacgctcttcttcgggcggtgggtcagggtaagctacgcttggcccgtttgcttctggagggaggcgcctacgtgaatgagggtgatgcgcagggggagactgcgctaatggcagcctgtcgggcccgctacgacgacccccagaacaaggcacgcatggtacgctacctcctggagcaaggcgcggaccccaatatcgcagaccgattagggcgcacggcgctcatgcacgcttgcgccgggggtgggggcgccgcggtggcctcgctgctccttgcccacggcgcagacccctcagtccgagatcacgcgggcgcctcggctcttgtccacgccctggaccgcggggaccgcgagacccttgccacactgctggacgcctgcaaggccaagggtacggaggtcatcatcatcaccaccgatacctcgccctcaggcaccaagaagacccggcagtatctcaattctccaccatccccaggggtggaggaccctgctcccgcctctcctagcccggggttctgcacgtcgccttcggaaatccaactgcagaccgctggaggaggagggcgtgggatgttatcccctcgcgcccaggaagaagaggagaagcgggacgtatttgaattccctcttcctaagccccccgatgacccatccccttccgagccgctccccaaaccaccacgccatcccccaaaaccactcaaaaggctcaactccgagccctggggcctagtggcccctcctcaaccagtcccacccactgaagggagaccggggatcgagcgcttgactgccgaattcaatggcctgaccctgaccggtcgaccccgtctttcccgacgtcacagcaccgaaggccctgaggacccgcccccatgggcggagaaagtgactagcgggggtcctctctctcgccgaaacacagcaccagaagctcaggagtctggtcccccttcagggctgaggcagaaactgagccgcatggagccagtggagctggacacccctggacacctttgccctgactcgcctgagtccagccgcctgtccctggagcgccgccgatacagcgcctccccgttgaccctccctccagccggctcggctccctctccgcgccagtcccaggagagtctgccaggggcagtatctccgctaagcggaaggaggcggagtccggggctgctggagcggaggggctcggggacgttgctcctggaccacatctcgcaaacgcggccgggtttcctaccccctctcaacgtcagtccccaccctcccatccctgacattcgcccacaacccggaggtcgggcgccttcgttgcctgcccctccttatgccggggcgccaggctctcccaggaccaagcgcaaattggtgagacgccactccatgcagactgagcagatccgcctgctggggggcttccagagtctaggtgggcctggggagccagggcgctgagaggagtgagaggagccaaggagggtggggattaggaccttaatgggataggtgggagaaccagctcacacacacaccacgaacaaagggatctcttgcatgtgctcatgggtgcacagtgcacccacacatggttaaacatgtgtccataagcacagtactcttattagcaagaaagaataagtactctatttactgggtatatacacacatgtattcatgccctggtcatttcacatgcatatgggattacttgtgtacctacaggcacagcatatcaataaacacacagggctagggtcccaaactctcttgcatttgttcagaagcagtagggaacccttacttatgggcagtctccgatgtctttgccctcctgcagaagcaatcccttgctttccatgtatgccctgaaacacagcctatcatgattttgcacactctctccgtggacatcccagcccattctgcaggtcttgcttctttctccaggcctggctccttattcacaccctgcttctaaccccaaccacttttcaggatatctttttcactcttcttgggggttcctgcagcaacccccagcctcagttctgctgctgtctttactgctctcaacttcacttctcaacttcctgctttttattcccaccctgttcctccaacaactacaacagattgtctcattttcccagggggtgggtcatgggctctaagctgctcttctgtctgtctgagcttatgaacacccccacaggtagaagtggggagaaaccctaaatcactcctctctccacttgacatatcaaataaatgtgttcagaagtctctgttttgtcacttctgcctggaggtgtgggtatggggaatgaggaatggggagggagggtaacactaacttatagctataattatccaagggatacttagctgttccagccaccttctttccaagaaaccaacttttctatagagaaaaggcaagtgtcctgtgtcctgaagattttaaggcatttgacaggatttcatttcctccagtttcctctatgtccaaccttgaattctttaaggttcctacaaagagttcctccctccatcatcagcagatatatcccagtagattaactgtctccttttgaaacttcctatttcttgactactcacagtttttattcagggtctaattttcatttcaccaagtgtgtttcttctattttcttctacttctggcctctatttccccatctttgatttctgagccactgtaggagagatggggggaagcagttaatataatctcacctaagcaaaaatggcctggtgaccacatgataaagggtatgtagagtgtgtgtgtgtgcatgtgtgcaagtgtgtgtgtgtgcaaagtaatcagaggaacccagtctgacatattataccaacaagggtaattttcttaattcccccaactggacttctcagtttgctaattttctgcatgtatcctaactctttctcactctaatgggaggcaaagagacttgcccatcccactctctcttattcccttcctctacttagaataagtgaactcagaaatttacccaacaatgtggcatagtaaaaagataaaaatattgggaatcagaacacctatgcttaaactctgaattccactttgccatctcttagctatttaattttggccatttttctagcttccctcagcatctgtttccttatccctaaaataacaaaatctagttagtgattgtgattgtaaataagacatgcactacagtacattgcatagtttatgttcattaaatgtcagtatctttcttgccttagctccaccaccaattgcatatgatgttggacaagtcgaattacttctctgagccacaatatcctcacctgcaatctgtgaaatgaaatggtaggacaaaatgatctctactctgtctgcaatcctccccaatcttgcatctaggcccatttttttcttcaagcccagccccaagattctgtcctgctttctagtgcttgccacaggactcccaaagacgcgccgaagctctgcgtctgcctttcagaggatacgctttttctctttgcaattggttctgagaatccccaccctcctcaataatttgcctatggcggagcaggagccctccagctcccgccccatcactggtgattggcatgggacctagctcgtccccgcccccacttgactgaaggttcggccctggcaccgccctgagtccccaggcgctagctgactggggtggttgggaccgttagctcggcaggctggcaggctccggggcgctactccattggcggccgggatggagactatgcgagcgcagcggctgcagcctggtgtgggcaccagcgggaggggcactctccgagcgctgcggcccggagtgactggggccgcggctgccaccgccacaccccctgcgggccccccgcctgccccgccgcctcccgcaccgcccccgccgccgctgctcctgtctggggccccaggactacccctgccccccggcgccgccggcagcccggcagtgctgcgagaggccgtggaggccgtggtgaggagcttcgccaagcacacgcagggctatggccgaggtgagtctgcgggtctggcctcctgcgcgacaccctctgtaagggagccttgctcccacagtcctccggatcgcttttcctggcgtggagccctcacatgcatttccttttggggagtttccttctgggctacgcacacgcacagacgcacacactcatacacacgtttaagcctcctacctcctcccctttactgagttattaatatattctccagggactctttttcagatacaatcctcttttcttcctaagcttttctcctttagaaatggaattcctcctccagcttaataccttaacatctctctgcctttgagaaccagtcctcattgtgtgggatcctgtcttttatttcagatccaatttctcatccataccctctcagtctttcctctgtgatctctgcaattcctggactcacctgttaatttgctccagccccttaaccttgactgttaaattctttacttacttaccttcactctgaaatttcagtgcaacttcagatttactggggaactaggtagtgccttcacaagtcactcatagtaattgtgtatttaaatccggacctgtaccactgaactcacagcagcttcctgtggctcagtaccttactttggtatcttttttagtatggagactcacaactccagcctttctgtctggctgtgttttcctggcccttgcccaggaactgaggataaatcccaggccttggctctttcaatgttaaattctgtggaaatgtgccaggttagaaactctatttcagttagaaaacttcgttaatttctggaaagagggatgtgagggttttctttgttgttttcgtttaactagggtagtttcctgtctgagtttgagttccagatttatagtgtaagtaataaggaatatatagtgaagggtgtggaatacagaatttaagcctggaatttacaagacatcccttctgtctgcttggccaggtcctgcctgacctggaagtgactatatctttaactttctgtttaacaataatacagagaaaagttacagggcttttctgtagattttctttttttaagaaagtttagtgaaaagagcacacacaggctttggagatctttgtcacttaccagccaaatctttggggaagggacttaatttcactgagcttcagtttcttcaagggttacaatatggattgactgagacattgcaaatgacatataacctaaaaatgattattatctcaaatttgttggttcatagttccttaagtagaacatgcttcactttttcccactcttaaatcctaataatgtaaacccaaaaattcctatgaaaacagatttttagagccattttgctatatgtgcctaatgattcattcatcatcaatttccctttgttcttcatacaatttgaactcctattataagacaggaactctgctaggtgctggggatacaaatggatgaatctgaaactcatgaggaaatactatttttccaatgtaatcccaagatttaacaaggctatgtgatggaactgctattagctactatcctgctgcttcaagtctctaagtcaagatcaagggaaggtctttgcctctgggcacaggagtagcctagagtggtcacactaaatctgaagccttcctcttggcaacttacaggcatttattaaaattatagaagagtacaccctttttcttgtctgtgttacctggagagcctctgctttggctcccaaactggacatcctgtaaaaacttccatttccttagcaaggatgagggaacaaggggattgtactgacaaagggcaattaatcaggcttcacacttcgtggtgattttctttcctatctccccacctcccatcgcagtctttctcattattcttgagtttctcatttccagtctgagtgtccagccagtactttaggaaagtctggcagatagttcagcttcaggcaagcagaatctctgcccatttggctcagaagtcctttaccacatggaatcacttattctgcttcaattcttaggcaaagctgccactggcatatattcacatacccttgtgactgatggcatgttatttgggggaatggctgtattcccctgaatacaatttactttagcctctgcctagacaattcattccctcatccagcaatgctttaccacatcatcttcaattaacatccttcatcttcttcctgaatgctccaaatccaccttttccaatcagtctttagatctaccttcactcatgtgggctatcagtatgtatgtatatatgtatgtatgtatgtatttacttatttattttaaaaagctttcctgtcctttatctgcctccctcacccacttacccaagatacacacacagctcagtattctgtaggatcttgataagtttgtagtgcatgggatttgtaatcagaggacctagccctgtcaaatagttggctgtgtgatcttggagaagttgcttaatctctctatgcttcatctgttctcttcattcatttaccaaatatttattgatcaccagatgcagtggtggacaaggcagatatttagtccctatcttgatggagctcacagtttacattacagagcatgtataaagattaatggtgtagtaaagcaggccagcccaatacaaagagggttgactttggagccaaacaaacattgtttctaaatcctggttctgccacttctggcctgttccttaacttgcttactttttgtaaaatgggtattataatacttatcctgatagttttgtgtggattaaataagacaacgaatataaagcatgcagcacctggtactcagtatggttgctactattgtgcatttggaaatgctttggaaactgcaaatgataggtactgttctgcattgccatttcctttgcaccctttttttctatggcatatagtctctttctcatgtttgacatctggcaatctctaaactggcaggatcgagtaactcactttccttgctctgtaattgctacatttccctcttcaaacctgttgttttggaagtattgctatccttttatgttacaatatggctgcatgattggagattttgccctgttatttcactaagttgaacaaatgaatcttgtgtagtattttctatttagttgttccttttcctcagaatcacagatagcttcttttctgtaagactgaagttaaatgggttgggctgaatatttccaatttttggaaatgctggattagttcctatattagtttcctgtggctgctgtaacaaattatcacaactttagtggcttaaaccaacagaaatttgttctctcatagttctggaggccagaagtccaaaatcagtattactgggccaaaatcaaggtgttggcagggccgtgctccctccagaagctctaggggagaattcattccttgcctcttccagcttctggtggctgctgacattggtttattacgtggtttattgctgtatcactataatctctgcctccgtgactcctcctcttcatcaaatatgcctcctttttttttttttaagaaatggaatctcgctgtgttgcctaggctggactgcagtggtgcaatcatagctcaccgcagcctggaactgctgggctccagtgatcctcccacccgcctcagcctcccaagtagctagactacaggtgcatgtcaccacacctggctgattttaaaaaatttttttgtagagatgagatcccacagtgttgcccaggctgatcttgaactcctggcctcaagtgatcatcctgctttggcctcccaaagtgctggaattataggcatgagtcagtgtgcccatcctgcctccctcttataaggacacttgtgaatgcacttagggcccacctatataatctaggtcatctccccatctcagatcatttaaactcatctgcaaagtctttgccagataatgtcacattcacaggttccaaggattaagacatggacattttggcaggtggcattattcagtctaccagagtcccctcccaaagtcactgttactttgcagtctctccttccaaagagactgtggatcgtgggctatttaggggcagatgtaccttctaaacattgaaataggaaatagatgaactattgttaactagcttccctatcttccataataatgtgaatagagtcagtctattctcgccatcctctatgatcaaggagaatctttttactcacctcttaacttcattatctctttattcctgcttccccaccacaaagttgtatttattacttttttcttttatttttgttaattaccttcctggcaaggttgtatttatccttatgatataaaatttttactgtagtttcatatattgttttaatatttttatcctggccaggcacaatggctcatgcctgtaatcccagcattttggaggccagcgcaggaggattgcttgaaccttagggtttgagaccagcctgggcaacatagtgagaccccatctctacaaaaaaatttttttgaattatccaggcatggtggcatgcatcttgtagtcccagccactcagggagctgaggtgggaggatcacttgaacccaggaagtcaaggctgcagtgaggtgtgattgtgccactgaattctagcttcagcgatagagcgagaccttgcctcaaaaaaaaaaaatgttttaggttaggtgcggtgactcacacctgtaatcccagcactttgggaggctgaggtgggaggatcatctgaagtcaggagttcaagaccagcctggccaacatggcgaaaccccgtctctactaaaaatacaaaaattagctgggtgtggtggcgtgcgcctgtaatcccagctactcgggaggctgagcaggagaattgcttgaaccttggaggtggaggttgccgtgagccaagatcatgctactgcactccagcctgggcgacagagcaagactttgtctcaaaaaaaaaaaaaagtttttattttggctgaaaatgatcactacctctcattcccatcctgtccacttagacattcgtatattttatctcctaaaggcaaaaactaaattattctcttttttgttattcaacagcagggtataagcactgaaatattcctatcttggtctttcttgtgagagactttgagaaaacaattatcagatgtgtatatctcagttcttcctaccctcccacctcactgttctttagccatccttatgtaaaccattatatccatggttcctcattgaaaatatgatacaaaatttgggtgctccacatatacccatgcacaaatactcatatgcatacagacacacacataattttacttaacagttttaggaagcttgtgaacctccatgaagctcagctgtggactggaccttggagcctgtgttaagattcccaaattggaaagaatattggcccccggaaatctagattcatgccccaactctgccatagctatgtgacctcaaacaagtcttctgttctttcttagccagcattggactagatgatctctaaagttccttccagccctaaaaatgaataagtctagaagcattttcaaatgcggatcacaattagttgcttttttcttgaccactttgcccaattatcatttcatactcacatttctaaaatcaagactccccatgtcccttggccttgagtaatcattaaaaaatgattctctagtctgtgcaaaggaatgtttaactggatagagactgaacatatgctttttaataggaccttcccaattatggtggtctcctcctcttcctctttattccagtattctccctgttgtgtgcatgtcaagagagctgtcacccagtgcattgtgctaaactgtctcaaagagggaactggagctgaaaagatctcacggaaagaacaaagatggctgagctttctggtcagtattgacctttgaagagccctgccaaaaccaatagaaggaaagagagttttcttttcatgctggatctttttttaaattttaattttaattttttttgcccatgacagagcctcaggaggtcctaatgacatgtgccctcatgctgtcttttaatagaagaatgagcattcttaaaagtcagttaaatgtaggttattaaaaagagtttatgctgcttctccaactcaggctagtacatgggtgtttgtttcagtcacagagcaggcgagataatttattattggccactgatttcaaattccttgcttgctgggcgcggtggctcacgcctgtaatcccggcagtttgggaggccgaggcaggtggatcacctaaggtcaggagtttgagaccagcctgaccaatatggtgaaaccgtgtctctactaaaaatacaaaaattagccaggcgtggcggcatgtgcctataatcccagctactcaagaggctgagacagaagaattgcttgaacctgggaggtagaggttgcagtgagccaagattgcgccactgcactccagcctgggaaacagagggagactccaactcaaaaataaaataaattccttgcttgcaggaactgtgagttattcttttcatgctcaatgcttagaatgatgccatgtacctattaagtgctcaaagttttgctaacgtgtatatgacagccatgaaaatgtgcagttctcattgcctgctgcagggagcataactaacagcctcagccactgcccactctgggtcatccataaccacatttgcaccacaaagtcgcacattcgcatccataaccacatttgaaggaaccacgcttcctgtaggctgctcccagccaatgacctagcacatcaggggtattaacacaggcagatcctggtgagatatgggattcctttggcatgaggacttctcactgacttagccaaatctttcttaaaactgtactacagccgggcgtggtggcttgcgcctgtaatcccagcactttgggaggccgaggcgggcggatcatgaggtcaggagatcaagatcatcctggctaacacggtgaaaccctgtctctactaaaaatacaaaaaattagccgggcgtggtggtagtcccagctactcaggaggctgaggcaggagaatgacatgaacccgggaggtggagcttgcagtgagctgagatcacgccactgcactccggtctgggcgacagagtgagaatctgtttagaaaaacaacaacaacaacaacaacaacaacaaaaactgtactacagtctgagattgtcatatctagacctccttctttccctctcttccacaggcatgagatctttgctgtgctcagaaggctctccctgttgtctcctacttcctccctgataaatctcttgcaattgtctatcccatcttggtgtcttcttggcagatctgaactaaggaaatatgaaagaacgaatgagactttgttgcgattaagagtagaagaggagaggccagacgtggtggctcacgcctgtaatcccagcactttggggggccaaggtggaggaggagcactttgggaggccgcttgagctcaggagtttgagaccagcctgggcaatgtagtgaaactctgtctctacaaaaattacaaaaattagacgggcgtggtggcatgcacctgtggtcccagctactcagaggctaaggttggaggatcgcctgggcctgggaggtggaggttgcagtgagctgagatcgctccactgcactccagcctgggcaacagagtgagattctgtctcaaaaaaaaaaaaaaaaggagagtggtcagtatgttgcaagatatttcagagcacctgggataatttattattatgaggctttagctaaaactatttgaaatgtttggaaccctagagccaatgtgatcctttctaaaagcaaactgatctcatccctccttttttttttaattagttatttttccttggagctgagttagaaagactcccttctttttaaagtcctccaattgcttcctattgctctaggataaagccaatactctaacatggcctaaaaggccctacttggtctggtccctgcctcctcttgcaacctcatcttgcattacacttcccctccctcactctttcatagccatatggtcttaattccctttattcatcatgttccctgccgtcatgagcctttgaacatgctgttccttacgcacagaacactgtcctctcacctcttgcctagtgaattcctagtcatacctaaacttagatattgcctcctcagggtagctttctttgaccttcttaactaggtcagatacgccgacatctatcactcctttatagaacttgatcacagctgcaattttacatttgtttgagatttggttaatatctctttccctctttacactgtaggctacataaggaaaacgtagggatgagaggaagttttctagaatacaatgtcaggtctggagtttgattttagcctacctacaactaataaattagccatttactgtttcatgggtgctggcagaagtcaagagactttgagatttagagacaaaggaatttattattcatagcacagcaagtagcatgagcatcatgtttatattagttctccttgcctcctcccaagtccaatgcagaggactcaggtggatacttgcataggccatgggttgcttcacaacagaggaacacttatagaacccacagcttggggaacttgccattttacaacaagctgaagcaagcaagttctttatctgagtgaaggtagtacctcatccctcaatatttcttgctgcaagcacagtcctgaaaaatagcccaagtaaagagcagtcagggatttgcaatcttggtgtacctagcaagatgtgaaggagcatgagagaccgacccatggaggagtgcttctttttaaagtcctccaattgcttcccattgcattgcttcgcatctcaccatatggctcctccaaaaacatttatacccaggtaaagcctcaaaagagttttctctcccacccccatgccctggcttctctcactcgtagtatgtacatagtattctgggttggaaaaggaatctggcaatggatgtgctcactagaagcacaggctcgagaatggttattagggctatatttccttgagccagcagtattgcataaaagaatattcattggaaccaagactacttgagtttgaatactcaaactgctactttctcctggcataaccttgggcaagttatttaacttctctgtacctcatttccctcatctgtaaaatatggatagtaaaaatatctgcttcataaagttgctgtgattaaacacgtaaagcagttacagaaatgggtgacatacagttcaatacatgttagcacttattgtggtggttattatcatcctgggccagctaaccaactgtggaataatctgcttgtatttcatcaggcagtgataatggtctgctgacattgggaactctgccttcaatatttaagttattctaggactaagttaaaatgtgaactattcagattggaggtgggagtgaaaaaaaaatttaaataaaataaaatgtgaaccagaaaagtggtggaggagggcaggcctactctggtctttctaggcaaattaacttaatcacagtctaggtttattaacttaaatgcttttcaatggcgataggtagggagctaaggggcagactcttaatgtaggtacaggttacaggtactgtattgaagtatagcaccacgtggaggtgttctcattcattgctgaacttaagtacttctcttttgtagtgaatgtggtggaggcacttcaggaattctggcagatgaagcagtcccgtggtgctgacttaaagaatggggctctagtggtttatgagatggttccctccaacagccctccttatgtctgctatgtcaccctgcctgggggaagctgctttgggagtttccaggtaagagttgtgaggtggcagtagcaaaggtaaatgcttagatgttagtaacggctttctccaccactttggccattaaactgcctgaaatcatatatttgaggacctaaagcaattctggggaaattattctggcaagcatctgaggccaatttgaccatagtagaacctcagtagcatgctttcctttcaaaaactcaaacccattttgaatttgagcagttatgaatatccccttgctcagtatatccgactaccagcatccaacccatgttccaatctggcttcagttattgcattccaactttcttccatctcttattgaggatatagaacaatattccttgcctccagtactttttcgtaggcaattactaaagaaagcaatgttggagttctctaagaggtcaaatcggagggactatgtatgctggaaacagtactcatctaagagttaggagatccaaatttacattcttctgaatatcaatggggcaaatctctgggcctcacttttcccatctataacatgaaggagataggttagattatttctaaagtcttttctactactaacattctacaattatgtgaaatacctatgatgatgaaaagaatggttgccattatgaggtagtagtgaaaaattatggactagtacgaatattctcatcaaagatggattttttacattgcagacagggaggcagccttctgaaatgtcaacttaaaagtctcaaatggaatttagagaaaataataaacacctttgttctgttttccatatggtttgtgaaacccttagacaaggttaaaggccctactgtgtgtctgcatagcaccttgaacttcccctatcatatcacttattacaacatatcataattgtttgtctctcctagtggactatgttccatagaggcaaagattgtgtttgtcttctttctcgttaaatccctaccacccatcttagtgcctagcagatagtaggcaaataatacgtctgttgcatgaatgagtgccattgcagcttagtttctgcctcaaacagaagcagtcctaaggaagcttcatttcaaatcaggtgatgaaattttttcccttagaacttcagtcatttcaggccgggcacagtgactcacacctgtaatcccagcactctgggaggccgaggcgggtggatcacaaggtcaggagtttgagaccagcctgaccaacatggtgaaaccccgtctctactaaaaatacaaaaattagctgggcatggtggtgcacgcctgtaatcccagctacttaggaggctgaggcaggagaattgcttgaactctggaggcggagattgcagtgatctgagattgcaccacggcactctagcctgggcaacagagtgagactctggctcaaaaaaaaaaaaaaaaagaacttcagtcatttcagagaaataactatatacccaagatgacaaatgtttatgctttcacttgtttttttttgtttttttgtttttttgttttttgagatggagtcttgctctgtcacccaggctggagtgcagtggtatgatcttggctcactgcaacctccgcctcctgggctcaagtgattctcctgcctcaccttccccagtagctaggactagaggcgcatgccaccacgcctagctaattttttttttttttttttttttggtatttttagtagagacagggtttcaccatgttagccaggatggtctcaatctcctgaccttgtaatccacccgccttggcctcccaaagtgctgggattacaggtgtgagccactgcgcccagcctgtgctttcacttctaagagaataagatctttccttcttctttttttttttttttttgagatagagtctcgctctgttgcccaggctggagtgcaacagcccgatctcagctcactgcaacctctgcctcccgggttgaagcgattctccctgcctcagcctcccaagtagctgggagtacaggcacctgccaccacgctcagctaattttttgtatttttagtagagatggggtttcgccatgttggccaggctggtctcgaactcctgacctcaagcaatccgcccacctcggcctcccaaggtgctggaattacaggcgtgagccaccgtgcctggctgatctttccttcttcttcccacctcattacattgttgaatgacttgaaaattttatgacaatgcccataactgaaacattatagtaatttgatttctgttatttttggaaagaggagaattgtctttcttggccttttagcctaaacttttttttttttttttttgagacagagtcttgctctgtcgcccaggctggagtgcagtggtgtgatcttgactcactgtaacctccacctcccaggttcaagcagttctccctgcctctgcctccggccaccacacccagctaatttttgtatttttgtattatttcaccatgttggccaggctggtcttgaactcctgacctcaggtgatctgcctgcctcagcttcccaaagtgctgggattacaggtatgagccacttcacccagcttttttttttttttctttcttgagacagggcctcactcttgtcacccagactgaagtacagtggcacaataatggctcactgcagccttaacttcatgggctcaagtgatcctcccacctcagcctcctgaatagctggggccgcaggcatatgccaccatgcctggctaatttttgtatttttggtagatatggagttttgccatgtttcctaggctggtcacaaactcctgagctcaagcaatcctttcacctcagccttccaaagtgctgggattacaggtgtgagccacctcgcccagccaggggcagggtgcaataactgaagctagattagaacatgggctgggtgttgatagtccgatatactgagcaagggcatatccataactgctcaaattcaagatgggtttgagtttatacctctttatccactttggcaggtgaaatttctccctctggttttcttcacagatgactttttaagcaacagcactatagagcaggccagcaagctagtaacagacaaatagaaacagacaaattgaagcactgggaagacttaggacttacttaccaagcctcatatgctgtctcagagagcctgtcagttaatagaaattaggaattattgatattagggatgcttaagtactaaacacatcctggtctacttatttattgtttttttaagacagagttgtgctctgttgcccaggctggagtgcagtggcacaatcatagctcactgcacccttgactcctaggctcaagtgatccttccacctcaacctcctgactagctgggaccacaggtgtgcaccacaaccatgcccagctaatttttaaattttttgtagagttggcatctcactatgttgcccaggctggtctcaaactcctggcctcaagtgatcctcctgccttagcctcccaaagtgctgggattacaggcatgagccaccatgcccaacccctggtctactttttattttaagttttcttttagagacagagtctcactctgtcacccaggctgcagtgtagtggtgtgatcataactcactgcagcctggaactcctggctcaagtgatccttctgcctcagcctcctgagtagctgggactacaggcacgtgtcaccatgcctggctaattttttcttttttttttttggtagagacaggggtcttgctatgttgcccaggttattcttgaattcctgggctcaaatgatcctcctgccttggcctcccaaagtgctgggattacaggtgtgagccaccaagcccggccttggtctacttttaaaaactgcaacatcactttcttcctttcctctaattactcataaatgacatagggcaaagaggcctttgagacagccaataaagatgaattataaaggaatactatggtggctagagatctgaagttgaataattttgagacttctgcagatcagacttgttctatgatacctatgttggatacaatataaaaacatgaattaatttttatttttttccttcttaagtcagctttccttcccttagttactcctctcctctttgtttccactgtggggaaaaaagaagtctataaattccttcttcagacttaaacccttctcagggatagctcctttggctcactacgttatttgagaaaatgcctgctcacagctaaaaatgaagtccgagattccaagatgggtgcttctgatagagaccagtggcctctgtagaagcagcctagacacagctttggttctaatcttgggttatctagaggaatccaaaaaaccttacctgtccgcagaacaagatacagatttctattaagccggccagaatctgacttttgagtaactaattctgtcgacagtttaaacgggtatttttcatgaccagtgattatatgctgacttaagcagccttcctcgttctgcattcagtttggtatgagctacagccctctcccagttccttaatgacttcaggatgttgaatcaaaattatgtttccaaacatcccaaccactttaccataaaaaccttggaaagtgtgttgaacacaactgatttatccaaagagcgtccaagtgttttctatctgaagtgtttccctcccactgttccttcctctctctcatatgcacaaatacacatattctcactctttctcccctgcctagttttgccccacaaaagctgaggcccggaggagtgctgcaaagattgcgctaatgaattctgtgtttaatgaacatccttcccgaagaatcactgatgagttcatcgagaagagtgtctctgaggccctggcatcttttaatgtaagttgtatggagctggaaggaaggagagtgggagatgggagaactggctgcttgggaagtcgtaaattactgtgaaacagagcatgaattcttgttttctttctggtccacctctctgttcttttgatttattctctgtcagtctattgtgtcatgtgctccacctgtcgcagtctctagttctgtatctgtgtttatgtgttttttgttgttttgtctctttcattgtgtctctttggtatctagaaacctttaattgcagatttatggaattgtagagctattccaaaatgaaaattgagcttcaattttgcttttgctaatttgggttaagaccttagtttctgcagttctttttttatgactgttttttattgtcacttgtctcctgcctccattacttcatcttattgataaagaagacttttataacaaaacgtctttttaggaacaaggaggataatttatttactctctttatttacaactgttctttcaaatgatgatgataagaataaccataattagccagacgcggtgtctcacgcctgtaatcccagcactttgggaggccgaggcgggcagatcacgaggttaggagatcgagaccatcctggctaacacggtgaaaccccgtctctacaaaaaataaaaaaaaaatagccgggcatggtggggggcgtctgtagtcccagctgcttgggaggctgaggcaggagaatggcttgaacccgggagacggagtttgtagtgagccgagattgcgccactgtactccagcctgggcgacagagtgagactccatctcaaaaaagaagaataaccataattaatcctaattgagtatttaccttgtggcagggactgttctaggggatttatatgcattttacctcatttgatcatcacaacaatcttatgaggtgtaagtactattattacccctattttacagatgaggagactaaaaacacagaagtggaatgttgcttaacatgatatagctagtaattggtcacgccaagattagaacccaagttgacttaatttaattacatcttagaaattaacaccgccatcttccttcctctccacaaattcattaatagtcagaccaagtatctgttctatttgcatttaattaagatgtaattacaggccaggtgcagtggctcatgcctgtaatcccagcactttgggaggctgaggcaggcggatcatctgaggccaggagtttgaaaccagcctggctaacatggcaaaaccccatctctactaaaaatacaaaagttagctgggcgcagtggtgggcgcctgtaatcccagctactcgggaggccgaggcaggagaattgcttgaacctgggaggcagaggttgcaatgagctgagattgtgccattgtactccagcctgggtaacagagcaagaatccgcctcaaaaaaaaaaaaaaaaagatgtaattacatatactaaattacttcagttatctgctttgtggattagttgttgaatactttattgaaagttggtttccctctgttatttaggacccagctgtttttctcccattattctttgccccagtcaacagcatctgcagggaatgaaaacatttttatattaatccaaaccaaataaaaaaagaaaaagccagctaaaattttttggaaagtacatttgctacttttaggtcgcctaatggtattataaaatgaaacagggcgaggcgcgatggctcacgcttgtaatctcagcacattgtggggtggatgccagcagatcacttgaggtcaggagttcgagaccagcctggccaacatggcaaaaccccatttctactaaaaatagaaaaattggccaggcacggtggctcatgcctgtaatcccagcactttcggaggccgaggtgggcagatcacgaggtcaagagatcaagaccatctggctgacatggtgaaactccgtctctactaaaaaaaaaaaaaaaattagccaggtgtggtggtgcgcgcctgtagtcccagctacttgggaggctgaggcaggagaatcacttgaacctggaaggcagaggttgcagtgagccgagatcacgccattgcactccagcctggtgacagagcgagactgtgtctcacaaaaaaaaaaaaaaaaagaaagaaaaggaaaaaaaaaaagaaataaaaaatacaaaaattagctgggcattgtggcacatgcctgtaatgccagctactcaggaggctgaagaatgagactcgcttgaacctgggagatggaggtgcagtgagctgagatcattccattgcacgccatcctgggcaacaaagtgacaccctgtctcaaaaaaaaaaaaaaatagaaaaggaaaggaaaaaaaaagaaactgtggattatggaaagtaggatgtgcagtatttatctgatcatgggctctaaattcattgttggcgcggtggctcacgcctgtaatcccagcactttaggaggcggagttgggcggattgcctaaggtcaggagttcaagaccagcctggccaacatggtgaaaccctgcctctactaaaaatataaaaattagctgggtgtggtggcgggcgcctgtaattccagctatttgggaggctgaggcaggagactcacttgaaccaggaggcggaggttgcagtgagccgagattgtgctattgcattccagcttgggtgacaagagcaaaattctgtctcaaaaaataaataactaaattcattgttattgaaattatggttctaggccaggtgtggtggctcacgcctgtaatcctagcactttgcggggctgaggcgggcagatcacttgagctcaggagttggagaccagcctgggcagcatggcgaaactccatctctacaaaaaacacaaacagttatctgggtatgggggcatgcatctgtagtcccagctacttgggggtctgagacaggagtatcacttgagtgaggaggtcaaggctgcagtgagccaagattgcactactgcactccagactcagtgacaaagtgagaccctgtctcaaaaaaaaaaaaaaaaaagaaaaagaaaaaagaaagcaattatggttcctggctgggcgctgaggttcatgcctgtaatcccagcactttggaaggctgaggtgagcagatcacctgaggtcaggagttcgagaccagactggccaatgtgttaaaaccccatctctactaaaaaatacaaaaattagccaggcatggtagtgcacacctgtagtcccagctacgtgggaggctgaggtaggaaaatcgcttgaacccaggaggtggaggttgcggtgaactgagatcgcaccactgcactccagcctgggcgacagagtaagacttcatctcaaaaaaaaaaaaaaaaaaattatggttccatagtcttcctttgggatctgtgtgggattggttctaggatctctcgaggacacctaaacccaaggatgctcaagtccttcatataaaatagcacagtacagcctgggcaacataaagagacttcatctctacaaaaaaataataaaataattagccgggtatggaggcacttgactgtgatcccagctacttgggaggctgaggcaagaggatcacttgatcctggggagattgaggctgcagtgaccatccactgtactctagccagggtgacagacagaatgagacacagtctcaaaaaaaaaaaaaaaagtacagtatttgcatataacctatgcacatcctcctgaataaatgctttaaatcatctctagagtacttataatacctaatacatgtaaatgctgggccaggcacagtggcttacgcctgtaatcccagcactttgggaggccaagacaggcagatcacctgaggtcaggggttcaggaccagcctggccaacatggtgaaaccccgtctccactaaaaataaaaaaattagccgggcgtgatggcgcatgcctatagtcctagctactctgcaggctgaggcaggagaatcacttgaacccaggaggcggaggttgcagtgagccgagatcgcaccactgcactccatcctgggcgacagagcaacagaatgagactccgtctcaaaaaaaaaaaaaggaaatttttatttttaatttaaaattttatttaattctcaaaacaatcatttaaggtagctctatgattattcccatcttacagaagaggaaactgaagaacagagaggttaagtgactttaccaaggccacgctatttgtaggagctccagtccatgctcttaacttctatgctgtattggtttttttacatgctaggcttgaatgcaggacagtgtgtcttaattctaaccctgcagggttacataaccaatagaagacacaataggccaatgtccaggagaccacactgctacccagaatttccacacttataccacatttcagaaagtcagtacaaaaatgtaaaatatttcattaataatgtttatactgactacagttgaaaaataatattttgaacatattgggttaaataagatatattattaaaattaattttacttgtttttttttttttctgagacagagtctcactctgttgtccgggctggagtgcagtagcccgatctctgcaatctccgcctcccaggttgaagtgattctcctgcctcagcctcctgagtagctgggatttacaggcacccactaccatgcccggctaatttttgtatttttagtagagacacggtttcaccatgttggccaggctggtctcaaactcctgacctcaagtgatctgcccaccttggcctcccacagtgctgggattacaggcatgagccactgcacctggacttacctctttatttttactttaatgtggcagagaggaaattttgaattaaatatgtggcttgcattatatttctactggacagtgctgcttgagatgataatcctggttgaaaatctatttgtcttttctgttcctctactaccagggcaacagggaggaagctgacaacccaaatacagggattggtgccttccgattcatgctggaatccaacaagggcaaatcaatgttggagttccaggtactttcccatgtacttccctggttctaataacatgggtcagcctgctactgtaatatataatggctcctactaattcctaactcattgatactggaaaagaaagaaggttgttacactatttttcaaaaataaataccttcctggctgggcatggtggctcaggcctgtaatcccagcactttgggaggctgaggcgggtggatcacttgaggccaggagtttgagacatggcaaagccccgtttctactaaaaatacaaaaattagctatgatggcacatgcctgtaatcccagctacttgggaggctgaagcacgagaattgcttgaacccaggaagcagaggttgcagtgagctgagattgcgccactacactccagcctgggtgacagagcaagactctgtctcaaataagtaagtaagtaagtaaataaataaataaataaataaataaataaataaataaatatttttcttccccaaaggcctatcagagttagtgatgagagatgcttctacaaatccattttgtaaaaggtttcccatgtaattctgatgcaacctcccaatataaaaatcactgtcctggtacttcctatcctcttcccccaggagctaatgacagtttttcaactgctacactggaatggcagccttaaggccatgagggaacgacaatgctctcggcaggtaagagattttatgagtgggggcgaatgaggggagcacaatctgtcagtggactcttttgaggtggttactatgttagaaataaggtctattgtgacctatggttgtgaatattgaaagccttacctaagtaccctcttcattcctataatctttcctgtgtaaatattagctgtgattcttttgtctatcttgcttcccgtagcaggaagtgcctttaagaatctccttgaagaacttaggtgctgacctcagttaggtctctaaagctgagttcttagtcccagttgggtcagtgtggtatgatatgaacctttaccttctcaatgatgttcacattcccctcccctactaggaggtgttggctcattattcgcaccgggccctggatgatgatattcgccaccaaatggccttggactgggtgagccgggagcagagtgtgccgggggcactgtctagagagctggcctctactgagcgggagctggatgaagcccgactggcaggcaaggagctgcgcttccacaaggagaagaaagatattcttgtgctggctgctgggcagttgggcaatatgcattcttccaactgctaggcatccacccacataactccccaggctttccacagcctttttttatgtctcctttctaagatttaggatgattttttgtacatactttctcatttttatactttaaaaaatatatatgtgtataaattctacacctagattcctatttgctaagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactctagtgttcatgtgtccttcttttcaaatatcaggtaacttgaataaggattatgtgccccacccttactctcattcctgcttcctcttggactcaaacagggtatgagtatgaagattttgcctttagttcctgaactgaacctgcttgctatccctttcctccccaccactaccttattccttctctgcctccaaattgccactttgttttgaggcttccttccctaccttattattctgaaggaagtagagatcttgcttctgaaacccctcctaagaaactgcccagggacaagataaattacaaacaattcatgggagtttactacctaagttgcttctagggcatatgtataccatactagtagtctagatttctggatatactctacagtagatgggggttatggttgaaactgattctctttcagtattccctctaaacatctcccctactcccccagcttagttaaaccctgcgtttggaccttcctgcctgcagctattagtagaaagtaaaacatatttccatatttcccttcacctaacattttattttttggaagcgttatcagtcctatttggttagtgagaaccatgttccccttattcccgctaagttgctgctgtttactaccttagattctcatttgttttctctttctttcctctccttccacattaattattagaacataagttgatcaggaaaattaaatgagactttagtattttggcacttcctaattgacaccttgggagactgcaggaagggaaagagaatcaatgatcagttatttgtgtgtgtgtgtggtttttttttttttttggaagacagagtctcacacttttgcccaggctggagtgcagtggcgtgatctcggctcactgcaacctctgcctccagggttcaagcgattctcttgcctcagcttcccgagtagctgggattacaggcacacgccacaacgcctggctaatttttatatttttagtagagacagggtttcaccatgttggccaggctgttcttgaactcctgacataaggtaatccacccgcctcagcctcccaaagtgctgggattacaggcgtgaggcactgagcctggcctatttgtggtttttttttggttttgtttttgtttttgtttttgagacggagtcttgctctgtcgcccaggctagagtgcagtggcgcgatctcggctcactgcaacctccgcctcccagattcacaccattctcctgcctcagcctcccgagtagctgggattacaggtgcccaccaccacgcccagctaattttttgtatttttagtagagacggggtttcaccatgttagccaggacggtctccatctcctgacctcgtgatccacctgcctcggcctcccaaactatttgtgtgtttttctttttttttttttttgagacggagtctcgctctgtcgcccaggctggagtgcagtggcgctatctcggctcactgcaagctccgcctcccgggttcacgccactctcctgcctcagcctccttagtagctgggactacaggcgcccgccaccatgcctggctaatttttttgtatttttagtagagacggggtttcaccgtgtttgacaggatggtctcgatttcctgacttcgtgatccgcccgcctcggcctcccaaagtgctgggattacaggcgtgagccaccgcgcccggcactatttgtgtttttaacaccattctcccccacttctctcctgggtgacataagagagaaataacctgtagtacagcagctaaagtattctcctttcagagaatttttttggaggtctcatatatatttcccccttgtctctgtgatctcttatttatactatattattgtcccatgtactttctaaactgagcttggaacatttagtattcctgcaattggacttcccacttaacaattatacagactttgcttttagaaatagattaggttccaaacagaaagttcaagtgtaacaacaacaataaaaatagattatgaaacaggctataattggctcttttggatttgataggggcaagatgaaaggcaactttcttgcttttgaaatcatgttgggtaagaggtaaggaatccagctacaattttattagtgcttgaaacgggcttccttgaattctccaggccctatcattttttttttcttactaatcagaagagagctggggtagaagccccatgtttgtattccatgaaacacgtcgggttggagtaaaggcaaaaacagctagacacaccaggtgtgtctgtttgacatttataagctggcactcatcaacactcctgtttctcctttctctgggacgtgtggattaaggggtgtgagttgtgggaagaattgccctcgtacctcctggatttattatttttctcaaataccaaccagtaagatcccaaataacttgagaaaaattgtttcctgatctgtccacttctggtgtcaaagattttactcatcttcttagtacattctatgtattttatatgtataattttatacaattaaaaatagatttttgtctagtgagccagactgactctttcttgagacctatatattacaaaagtgaaggggtgggttgcccctccacacctgtgggcgtttctcgttaggtggaacaagagacacagagacaaagtatagagaaagaaaactgggcccagctgaccagcgttcagtatacggaggatccacgccagcctctgagttcccttagtatttattgatcattattgggcgtttcccggagagggggatgtggcaggatcataggataatagtggagagaaggtcagcaggtaaacacgtgaacaaaggtctctgcatcataaacaaggtaaagaattaagtgctgtgctttggatatgtatacacataaacatctcaatgccttaaagagcagtattgctgcccgcatgtcccacctccagccctaaggtggctttcccctatctcagtagatggaatatacaatcaggttttacaccgagacattccattgcccagggacgagcaggagacagatgccttcctcttgtctcaaccgcaaggaggtgttacttcctcttttactaatcctcctcagcacagaccctttacgggtgtcgggctgggggacggtcaggtctttcccttcccacgaggccatatctcaggctatcacatggggagaaaccttggacaatacctggctttcctaggcagagatccctgcggccttcctcagtggtttgtgtctctgggtacttgagattaggaagtggtttgagattagggagtggtgatgactcttaacaagcatgctaccttcaagcatttgtttaacaaagcacaccctgcacagcccttaatccatttaaccctgagttgacacagcacgtgtttcagggagcacagggttgggggtagtgttacagattaacagcatctcaatgcagaagaatttttcttagtacagaacaaaatggagcctcctatgtctacttctttctacacagacacagtaacaatctggtctccctttcttttccccacaagaagctctaaaacatccctgttcttttacatatatactaaagaagaatttttaggccaggtgcggtggctcatgcctgtaatcccagcactttgggaggccgaggcgggtggatcacgaggtcaggagttcgagaccagcctggccaccatggtgaaacccccatctctactaaaaaaaattaaaaattagctgggcatggtggtgggcgcctgtaatcccagctacttgggaggctgaggcaggagaattacctgaacccaggaggtggaggttgcagtgagccgagactgagtgattgcactccagcctggacatcagggtgagactctatctcaaaaaaaaaaaaaattttattagcatttttggggtggtagaaatgattgcataaggcagcctgcctccctttctgcagatatttaacctggagtttgtccttggtcttttctcctcaagctctacctactcccactggcaatctcacccattatggtgacttgaactccactatacacatgactctcaaatctatttcttcctccccaacctgttttaagcttttacatttactttccacatacttgacacggccatctgaatatgacaaaagcactttgaaacatatcgaaaataaaaaacatttctccatactcattcctctttgactctctagattattcgaattattattattcttattattattatttttgagacgaagtcttgctcttgtcccccaggctggagtgaaatggcgcgatctcggctcactgcaacctctgcctcctgggttcaagcgattctcctgcctcagccttctgagtagctgggattataggcgcccgccaccacgcccagctaatttttgtatttttagtaaagatggagtttcaccatgttggccaggctggtctcgaactcctgacctcaggtgatccacctgcctgggcctcccaaagtgctgggattacaggcgtaagccaccatgccccgccgatctattattagaattattatctacactgttacctaagccacacacctcagatccaccctcaactcctctaccataatgtaaatatgttgtttttgagacagagttttgctcttgttgcccaggctggagtacaatggtgcagtatcagctcactgcatccactgcctcttgggttcaggagattctcctgcctcagcctcccaagtagctgggattacaggcacccactaccacacgtggcaaatttttttatttttaatagagatggggttttaccatgttggccaggctggtctcgaactcccgacctcaggtgatccgcccgcctcaacctcccaaagtgctgggattacaggtgtgagccactgcgcctggcctacctcctaatatgttttgtccatatttactgcctgagcttaggtttggtcctttctcatctccagactggatcactacaatagcttcctagctggtcttcacctccattcttaacatcctccatactactgtcatatttctttataaaatacttatgactgtgacactcccttgcttaagccatcactgaactatctttacctttagcagcatttcccaaagtttttttttattttttttgagacagggtctcactctaatgagcaggccagaatgcagtggcgtgattttggctcactgcagcctccacctcccaggctcaaggaatcctcccacctcaacctccagagtagctaggtctataggcacacaccaccacacccaagtaattctttttaaattttttgtagaggtggatcttgctgtgttgcccaggctggtattgaactcctgaactcaaactatccacctgcctcggcctcccaaagtgctgggtttacaagcatgagctaccatgcctggcctaccatttcccagttttatatgtgttcctgagatgattttagatgatagatgggcaaacagtttttaatagttgtgcttttatctgaattcgtagtagaaaaatactgattttcctttcagtgtaaatttatgtttaaagtcagtctatttaaggaaaaataataagcaacaactagtatggaggctattttcaaatattaaaaaccatgaatactcaaatatttgaagtaggtaaatttcttgcctataggataaattccaaaatccttagcacagcagaccctaaactgtatttccagctttattttccagtcacatagcatcgggcagacagaatttcctgccattctaatattcattcattcgataagtatctaccaaatgtctaccatgagccagacattgggctaaacttcagggattttagttgtaaataactatctctgctataaggattacattctaacgggaaaaacagacaataaacaagttagaaagtaaacaaggtaattaaagattctgactggcctaagcaacatggcaagactccgtctctacaaaagattttttaaaaattagccgtgtgcagtggcgtgtgcctgtagtcccagatattcgggaggctgaggcaagagaatcacttgggcctgggaggttggctgctgtgagccataattgcaccactgcactcagcctggttgacagagtgagaccttgtcttaaaaaaaaaaaaagaatgaaagaagattctgatttaagttctgtgaaggaaatacacagttaaagacaggagggtagagaagacccctttgggtgacagtactattgagatcttaaaaatgaggtcgaactcggccgggcgcggtggctcacgcctgtaatcccagcactttgggaggccgaggtgggtggatcacaaggtacggagttcaagactagcctggccaatatgctgaaaccccgtctctactaaaaaaattttaaaaagctgggcgtggtggcacgtgcctgtagtcccagctactccggaggctgaggcagaggaatcgcttgaacccagtaagtggaggttacagtgggccgagatcgtgccactgcactccagcctgggtgacagagcgatactccatctcaaaaaaaaaaaaaaaaaaaaaaaaatgaggtcgaacccaatatgtgaaaagctagaggaagagcaccaggaacagaaagctgcggggagcagtggctcatgcctgtaatccaaacactttgggaggccgagaagggcggatgaccggaagtcaggagttagaaaccagcctggccaacatggcgaaaccccgtctccactaaaaatacaaaaattagctaggtgtggtgccgcacgcctgtagtcccagctaatcgggaggctggcgcaggagaagccttgaacccaggagacagaggttgcagtgagccaagatcgcatcactgcactccagcctgagtgacagagtgagactccgtctcaaaaacaaaacaaaccaagttgcaaaagccctgggatgagaaagagcacaccacagttgggcgaaagagcaaggagagcttcatgggttaaggagaagaacggtggttgaacaggttgaaaacacaggcagagcaggctttgtgagtttgaatttttattctaagtgcagcaaaatgccaaggaaagagccgggtgcatggttacacccctgtcgtcccagatgcttgggaggcgagtttcaggccagcctgggtagtataaccaaacccctctaacaaaaagggtttttaggccgggcgcagtggctcacgcctgtaatcccagcactttgggaggtggaggctggtggatcacttgaggtcaggagttcaagaccagcctggccaacatggtgaaatcccgtctctactaaaaatacaaaaattagccgggtgtgtgtgtgtgtgtgggggggggcgcctgtagtcccaggtactcaggaggcttggagggcgcctgtagtcccaggtactcaggaggcttgaggcaggagaattgcttgaacccgggaggcagaggatgcagtgagccgagactgcaccactgcactcttagcctgggtgatagagcgagactacgtctcaaaacaacaacaacaaggatttttagtaggtatgtaaccaactgatttttaaaatgatcacagtacctactgtggagaatgaattagtgtctcctaatcgctttttaaattttatttttcgttttactcttattcactttttttttttttttttgagacagagtctcgctcttgtcccccagactggagtgcagtggcaagatctcggctcgctgcaacctccgtctcccgggttcaactgattctcctgcctcagcctcctaggtagctgggattacaggtgcactccaccacgcccagctaatcagcttccgtttctcgggttcaagcgattctcctgcctcagcctccctagtagctgggattacaggcagggagttttatatttaaaaaaaaaattgatatctgtctcaccaaccgtattgcaaccaagtctgttagtttcctgaagagaaatttggtgctgcaggttccagaagcagctctttatgccctcactgctgatcaaactattttttaaaaacgctcctatcatacaccacgctgcctaaagacaaggtacaggcctgggatttttgaaagaaaagggtttcttcaattaccatttcccagtttgggatgaagagacgtaaagaagccctctaataaggaaattacgccgggcctcactgttaatagtacagtatttatcagcagctgccgcggttaagaggaagccacggccccctgtagtctgtacctcctaagatggatgatttagcttgcgatctgttcaagatggccacagaaacacttccggtatctttccgcactaggcccgccccaatttgcgtgtttttaccgtgcagagggagggatttagagttagcctttgattggtcagcttgactggcgacctttcccctctgcgacagtttcccgaggtacctagtgtctgagcggcacagacgagatctcgatcgaaggcgagatggcggacgtgctagatcttcacgaggctgggggcgaagatttcgccatggatgaggatggggacggtgaggacagtggagacggctggtgggaagcggggaaggtgcgagagaaggctataataggaaaatttactcttttttcctcggtcgtaaggatgggaatcgaggaaccgggtcttgggtggattagagattccgcccccttcaggagaagggagggcgtgaccgggaaggcactaagactggaggcggtgtgggtcggcttgctggtagtgtattgggaaagagacgattgttacaaatgactgtcatagttacttattcttttatcttctggggttccagagagcattcacaaactgaaagaaaaagcgaagaaacggaagggtcgcggctttggctccggtgagtgtggggaaaatggggtagagtggcctagtagggcaggagctacgggttttggagtccccacccacctcataggaacaatgggagaaaggaggagttttcggtgatctcgtgtatgtcccttatagaagaggggtcccgagcgcggatgcgtgaggattatgacagcgtggagcaggatggcgatgaacccggaccacaacgctgtgagtaataatggaacctgtgaggtatccgtgtctgtggtagtagttagaaaccaataaaatagttaaacgcagtaggaatgggttcagagatagcttaaacaatctgagtccgcactcactctattcctgtgagcctgcttaaagtgtctctcatgtactcatacaacttccccccgtcccccaacagctgttgaaggctggattctctttgtaactggagtccatgaggaagccaccgaagaagacatacacgacaaattcgcagaatatggggaaattaaaaacattcatctcaacctcgacaggcgaacaggatatctgaaggtatcctaagtgacactttattgcctcctttctttcataagccttaggtagcattcgtagttctgtgtttgctgtggttggccaagagcaaagttgaaataaaatgacattggaaatctatgttttgtcagacacgccaaagagacagaaacggagatgatgtatatatacagtagagatatatgatgtacattcattgtttaaagtgtgtagatttttctgagtttagatttgaggaaaaagatactcagtgatacttggggaaataggagggttttcatatctgtcttttcactttccccaggggtatactctagttgaatatgaaacatacaaggaagcccaggctgctatggagggactcaatggccaggatttgatgggacagcccatcagcgttgactggtgttttgttcggggtccaccaaaaggcaagaggaggtaaaatgaagagggcaaatactgtctgggtgaagggaatacgaacgaaacagaatgaggacttagtattatgtccctctaatggactcctctccctgcttctttttccctagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcacctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgctattgggctgcccctccccctttttgttaaattgctgggttttccaactgaatcagtaaaaactatttctgtttagagctacaaggttaaagtgcctgctttccagtaatggagattgagtcactattaatttgataaaaggtaagctcagtaggcatcagattcctagatacaaggcatttgggaaagtgattttagcagacatgagggacatttaggaaagatgaatagtttcagcctaagagaattttgtgaactgtttggagttacgatcaggctactctgagctagttgggaaatggtctttcctcttcccatctcttgcattcatatatttctaagttttttttttttttttgtttttgtgctctgcctaagaagtgcttgagaattgtgaggagtataaaaatagtcaaagctggctgggcgcggtggctcacgcctgtaatcccagcactttgggaggctgaggcgggcggatcacgaggttaggagatggagaccatcctggctaacacagtgaaaccctgtctgtactaaagatacaaaaaactagccgggcgtggtggtaggtgcctgtagtcccagctacttgggaactcgggaggctgaggcaggagaatgacctgaacccaggaggcggagcttgcagtgagcagagattgcgccattgcactccagcctgggcgacagagtaagactgtctccaaaaaaaaaaaaaataataatcaaagctcttggatttatagtttggtccacagccttgttttgatctttcctttatcctgttttattgccatttaccacgtactgtagaaacatccctttcaactgctgataacttggaaacaagcctacaaaaataagtaatttctaactactcctaatactacctataactacccctaagcccttaccactctaacgtgacattattaaattttttattttattaacactaatattttaactacaattacagcatatgggcaatacagaatttacctaaaaggatactaatttggaacaaaaaaaatcacctttcgcacatgtatcatgtcacaaccagtttgccattgaaacaaatagaggttgcaaatattgtcagattgtcaggctgtaagaaaggatgaaattcatttcccattgcatcatcttgtggcccatggatttcaagtgccttagccaaaatcatatagctagttagcagtagagccgagactcagaaaaaaacaaagtaaaacaggcagactgaaacaaaaagtcttctaattcccagtccacatgtaaaatttgcttcatataaacaaacctaattgtaaatggcactgtagcaacaggcttctttttaacacttggattggtaaaggtcttgtttgcaacatattagaagtattatttttctctttcccccccaccccacccccaacagagtctggctctgccgcccacgccggagtgcagtggtgcagtcttggctcactgcagcctccacttcccaggttcaagcaattctcgtgcctcagcctcctgagtagttgggattacaggtgctcaccactatacccggctaatttttgtatttttagtagagatggggtttcgtcatgttggccaggttggtcttaaactcctgacctcaagtgatccacccaccttggccttccaaaatgctgggattacaggcttgagccaccaggcctttctttgttcttaggagtatagtcagactaacttctagtagttatatttctaataattgaggatgtaagtaaggatcaaatcttaaatcagtataatgcattgtcattccagagataaatcctagacccttcttggcctccttctgacataattctaatcctacagtctcagagatgctgttgtatcctgccccccaaccccatgatagtgatagtggtttttgccttgaaggaattgctttgtatttagcttttccccctctagatttctagttccttttcagtattggattggatttgagatttgattaacctagtactcaggttcagatgctcgcctctttgcaattttaacactcattcgacaataaagtcagtaaaaaacacaaatttggttatgtcactctctttttactttagtgtctctccactgcactcagaataaagtacaattttattatttgtgatctggcttgctcttcccctctcagttcattactcaccattttctagtcctcagctttagtagcattgagatcctctatcctccatcctccctagcatttctcctattttaattggtctaacacctatctctgaagaatcaaattttaacatctggaaagcttttcctgactgcacggctgtgtcagacacccctatccactccccacccccattgtcttctttagctcctttagcataacacttttgaatacactatattgtaattgcctaatttctttgtttcttgcagtagtctatacatttcttgaaggcaggattttgctgccctgtccttagcaaaatttgagtggcgctggagatgcatattactttttgaatggataaatgaaatgtaccacaaagttttacccaaaccactgacttcactctcttaatagatccccatgtatgtttttcttccctgccccaatctgaaggaggtgaaattgggaggatgcaaagaggtagaaaccacgtgtaataaaacagatgtaatggaagaggcacagatagaggatactgtttttacaaggcaggctcttttattattattattattatactttaagttttagggtacatgtgcacaatgtgcaggttagttacatatgtatacctgtgccgtgctggtgtgctgcacccattaactcgtcatttagcattaggtatatctcctaatgctatccctcccccctccccccaccccccaacagtccccagagtgtgatgttccccttcctgtgtccatgtgttctcattgttcaattcccatctatgagtgagaacatgcggtgtttggttttttgtccttgcaatagtttactgagaatgatgatttccaatttcatccatgtccctacaaaggacatgaactcatcattttttacggctgcatagtattccatggtgtatatgtgccacattttcttaatccagtctatcattattagacatttgggttggttccaagtctttgctgttgtgaatagtgccgcaataaacatgtgtgcatgtgtctttatagcagcatgatttatagtcctttgggtatatacccagtaatgggatggctgggtcaaatggtatttctagttctagatccctgaggaatcgaaaaggcaggctcttaacagatgtaaattaacatacaaataatcttacagaagagagagcagaggtagcagggtgcggtggctcacgcctgtaatctcagcactttgggaggctgagacaggtggatcatgaggtcaagagatggagaccacctggccaacatggtgaaacctcgcctctactaaaaatacaaaaattagccgggcatggtagcgggcgcctgtagcttctcgggaggctgagggaggagaattgcttgaacccgggaggcggaggttgcagtgagccggcaaaaaaaaaaaaaagcaagcagaggcttactccctgagaattaatggctaatggcccccaagcgcaccctttaactcatgctatggacccaaatccctgtcctgcccggtcctgagtcctaggtcactcacctgggggaaggcaagcaggaaactaagtccccaggctgcccccagaagtttccttacacctgaacgggatccaagcgggttgagtactgctgcctggcggtccaatccaatgaccacaggcaggaaagctgcagaatacgtggccattagtttcaggaacatcagtgtccgacatgcgatgtccacagccagccattgaacagtgatattccaggtggcatctaggggcataaccacaaaagtgactagtaagtcggcggctgctaaatggatgaagagtctcctgaccggagaggggcggagctggctgggttcccgccgtgtcactgaccacaggactgccaggttccctccagccgaagaaacaaacagcacaatggtcactcccactcggaccttggctgctgccgagaaggtgggcagctctgagccctccacctccactcctgatccagcccagacctcctcccccgctgctgaccccaaggggtgccgttgcctgcagacatggtggcctggagagaaactgaggaggatgaagtgtgggtatgaagcggttagctttggccactgattcttcgccctccttttcaggatctggagctgattattgcgaatttcgttcactaaagcctctgcttctggagactctccatctgttctggaggaggtcacttgttcaactgtcaaggttctgcagggaacgaagatctggtaccaatcacgctcctttttccttggacagaccagcctgggcttcaggcctctactgacctagacctctttagcccctacagccctggattcagtcggggcctgcgtgcatgtgtatttgtgaggttctgccaggcgcacacctatgccggcggcctccaagacgtggagatcactgcggcgctttctcgccccgccccggcccctgcaggccccgcccttggtcatgaatatttaaagaagaaggtgccgctggaggcgtgctagggagtaggggtcgtctgataaggggaagctgtgacgcagacacgcacagtaatacacagatggaggctcaaaagacacgagtttcgcgtcctgaaattccgcttccagggccaagctttcttttctgatactgtttgtccctcgcgaggcaccgttgggtcgcgcagtaggcgtgactaggggcgggaagtggggcgggagcagggccgcggagcctgggctgcggctgtcatggacgcctgggtccgcttcagtgctcagagccaagcccgggagcggctgtgtaggtgcggcccgaataggaatgggggtggggcgggggagggatggacagaggaagactctagtgaggcgaagtcagtttaggctacaggggggtcaagaagggtcaactccggctacgggggcccgaacggaccgtgaggcgcagatttgagccgctgttgagatgattcctttccgttcgcggaagagatggggaaactgaggcatgagtgggccagcggggaggccgctcagggttgctgtgtccacataagaccgacagtgtcctcactgggcggtgatggaatgaggagcattcgccccacggtggatagccccagactctgcccccagagctgaggaggcactcccagtttccgtgtccccacaccgtgctgccattcgggaactcccctgcctccgccctggcgtttggtctccattcagctagagggccttgaaatctctcagttcacctattctgaggaataaaatgccctccaactgtctgcctccccctcatcgatcacgtacatgctcacgctgatgtgcttgtgatggacccctgcggcctgcactggccccttcaggcctcatcattgtcaaatctctaatttgctcaacattcagtagtgctccccacccctttctagactcttttttctccttatgcctttcccttcctctggcctggagaaatggtgagatatgggcatggaggaggaaggggagtgttctcaaactgggaaagggggaagtctgtctgtgccttttggaagatagttttgagcggaaggttagggaggtctccaccttaccttgcctgccctctcctctagggccgcccagtatgcttgctctcttcttggccatgcgctgcagaggcatggagccagtcctgagttacagaaacagattcgacaactggagagccacctgagccttggaagaaagcgtaagtaactctgtctttccttttatcccccaacctttcctccatccccagctcaccttcctttgtccctccttcctgtaccctctctgttcttctttctcatttggctctgcacttaccctctgcatgagtccagttgagataagagagcaggggtatggaagtaattaggcggactggagagaatgggtcaagtttgagaaaactaaactggcacaaaaattaaatttgaaattgaaaaatggactgtttctgctctttattttttatttttttgagacagagtctctcgtccaggtcagagtgcagtggcgcaatcttggctcactgcaacctctgcctcccaggttcaagcaattctcctgtctcagcctcctgagcagctgggactacaggtgcccaccaccatgccgggctaatttttgtatttttagtagagatggggttacaccatgttggccaggctggtctcaaactcgtgacctcaggtgatccacccacctcggcctcccaaaatgttgggattacaggcttgagccaccatgcccagcctgtttctgctctttaaaaaaattgtcattattattgctcaacttttgccctcttgctttctctgtttctgtttcttgttatctgcctctccacttacaaatccttgctttccctttctaatctccacaagttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtttgatatcctgttctcctttaagatttttttttgtagcctctatattgcatagcttgtcttatatgagggaaagatatcttaggatctttccagagtatataagtcttgatcagtcacttggcttccaatcacttagatcttaaactatcggagaatatcaaatggggagagatggaagacagatgctcttccataatgaatgactaatattgtgcaaggtaagatattatatcactttaattgtgcttctataccacaggttattccccctcactacctgcttactcattcattccaaagatatttattagatgcttactgtggcgcaggggataaagcaaagagctaaacagataatgtgcctgctcccatgaagcttctagtttagtgagggagttagatactacaatgaataacttctcatatatatttgtggaaaagtatgcggtattatgaaagaatatcacaaggggagctaatttagattggaaaatcaggaaaaaactctttgagaaagtaatattttagctcagacctgatgtctgagtaggaggagttagacaaagccaacagtagcagaaaagacatttccaaacagagaaaattgcacattctaagtaaggctttgaactaagaaagacttaagggaattagagaaatagaaagaaagccagtgtgattgacagtattgagtccatcagttcaaatttgagagatagacaggcaccagatctttcatacagggccttttaggcaatgttaatgtttgttttattttatcctacaatgggacattattgaaggattctgagcagggaaatgacatgattcaaattgtgtttaaaggacatctctttttgagatgttgaaaatggattgcaggccgggcgcagtggctcacgcctgtaatcccagcactttgggaggccgaggttggggggatcacgaggtcaggacttcaagaccagcctggccaacgtggcaaaaccccgtctctactaaaattacaaaaattagccaggtgtggtggcgggcacctgtaatcccagctactcgggaggctgaggcaggagactcgcttgaacccgggaggcaaaggttgcagtgagccgagatcgtgctattgcactccagcctaggtgacaagagcaagactccatctcaaaaaaaaaaaaaaaagaaaagaaaagaaaagaaaatggattgcagtgggtcaagagaggaggagatgccctaatacgagcaagagatgacgttggcttggacaaaggaggtagctgacaataaaggtagagagaaatatgatgtgggagtaaaattctctaacatattatctgtattgtttttcgttttcctatgattgtactttttcattatattaaccttgcttttcccttcatctttctcagtgatttacaactttaacatggcttatgatgtatgaggggtgggagcagaggcatggctggagcagtatggaaaagcaactccctaaaggagtctatatgttatatttattcatttcatccaacagatacttactgagctcttactatatggtaggcaccagtgtacatacagggatacagtggttaaagataaacaaggccggccaggtgcggtggctcatgcctgtaatcccagcactttgggaggccaaggcgggcggatcacctgaggtcaggagttttgagaccagcctgaccggcatggagaaaccccgtctctactaaaaatacaaaattagccgggtgtggtggcgcatgcctgtaatcccagctactcgggaggttgaggcaggagaatcgcttgaacccgggaggcagagtttgtggtgagccgagatcgtgccattgtactctagcctgggcaacaacagtgaaataccgtctcaaaaaaaaagaaaagacaaacaaggcctctgctcctctggaacttaccttgtaatgggatgagataaacataaataaacaataaattaaaatatcagatactggtaaatgttatgcaggaaattaaaacagtgttatggagtagagagtaactgactcagtgctttagatttagggataagggaaggcgtctccgaagaggtgatacttaagctcatacctgaagagcaagaaagagctagctatgtgagggttttggagggagaatattccaggtggagggagaatattccaggtagagggaataggtagtgcaaaggtcctaaggcaagaacaagcttgatgggattaaaatgtagaaggaaaccaacatggttggagcataatgattgcaggaaagaatgatacaaggtaaagttagaggggtagggaccagatgttgagtctgtaagcctctctaaggtatttatattttattatgaatgtgacaggaagaaaaccatggagagctgtggtttgtttatttgtttttggttttttttttttttgagatggagtcttgctctgtcgcccaggctggagcgcaatggtgcaatctcagctcactgcaacgtccatctcttgggttcaagtgattctgctgcctcagcctcctgagtagctgggattacaggcacgcgccaccacacccagctaatttttgtatttttagtagagacagggtttcaccacgttggtcaggctagtctccaactcctgacctcatgatccacttgcctccacctcccgaagtgctgggattataggcgtgagccaccacgcctggccaaccatggagagttttaagaagggaagtaatgatgtgatttatgtttatgctagctattatatgaaaatagattgttgggggtgggggcaacaatggccacagtgagaccagttaaaacattaaagcagaagtccagacaagagatgttagtggcttagagtatggcagtgcggtgtgatagagagatgtggttggttgggttcaggatatactttgaaggtagtacaagttattgagtacagaccaccattgtcagattggattacaaataaaaaacatggattttttactgaagaaatttataatttaacacatttggcaattacttaaacctctgggcctctaaaggaatagggattggatttagatcacctttaatatgtttgagtctctgagacatctgaaatttgttctttcaaaacaagtttgccttgttataggtcaagttgagagagagatggagagtgtgtgtgtgtgtgtgtgtgtgtgtgtgtgtgttgccaagtggaaaatgaaatttgagattgaccttggaagatttcatgatgctcatggagtttaaaccaggatcttaaggtgcacataaacatgtattagttacagaatgttgggaggactttgtttcttcatttttattgggacataattgacaaatagaaattacatatatttaaggagttatagctcgatgtttgtacatgtacgttgtgacatgatcaccacagtcaagctaattaacatatccatcacctcacataattaccttttttcttttatggtaagaacacttaagatctaccttcctggcagatttcaaatatacaatacagtattgttaactatagtcacaatgtagtacattagatctccagaacttactcatcttgcataactgaaacttatacgctttgaccagtatcttcccatttccctcactccccaacccctggcaacccccattctattctgtgcccctatgagttagccttttttttttttttttgagacagagtcttgctttgttgcccaggccggagtgcagtggtgagatctctgcaacctctgcttcctgggttcaagcaattctcatgcctcagcctcccaagtagctgggattacaggtgctggccaccacaactggccaatttttgtatttttagtagggacggggtttcaccatgttggccaggctggtcttaaactcctgacctcaggtgatccacctgccttggcctcccaaagtgctgggattacaggcatgagccaccacgcccggccttattttagcttccacctataagtgagattatgcagtatttgtctttctgtgtctggcttattttgcttagcatagtgtcctcgatggaggacatttctaataggggtaatagcattcactttacttctgatctaatgtgtaatctctttgctacaggaaaagaaaatgttaaaatgtgatgttggatatgttaagtaggtatacatgcccttactgacccttttgctctgtgtatcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgacatttggtctggtccctcattttttggtaatttgaggcccctattcctgtcactgtggtttgggtttttctcgggattagccactaacatcacccacattatttttcttgagcacctacagtatgtaaagcaacatacttagtgggcatccaaaaatctaagaagctccacactcccaactttaagaagtttataacctagctgaggagttggggtggcagaggagtggtctaatactaaagttattgtcctggctccacaaagcacatctcataccagttcagatataatccctctaagaagcagaatgccatatgacagcataggctaagagccaaggacagaaccaagtggagtggggctggtaaggatttggagctgtgtcttcacaagttgagactcccctgggtgggtagggaaatgataccactgctatcagctctttcattttccatattccaggttgagataaataaggttaggaagtgaatctatcggccaggcgtggtggctcacgccggtaatcccagcactttgggaggccgaggcaggtggatctcttaaggtcaggagttcaagaccagcctggccaacatggtgaaaccctgcctctactaaaaataaaaaattagccaggcatggtggcatgtgcctgtagtcccagctacctgggaggctgaggcatgagaaatgcttgaacgtgggagacagaggttgcagtgagccaagattgtgccactgcactccagcctgggtgacagagtgagactctgccttaaaaaagaaaaaaaaaaatctgaatctatctcctatctcccagctgggtgcagtggctcactttgggaggctgaggtgggaggattccttgagttcaggagttcaagaccagcctgggtaacatagtgaaaccctgtctgtattctcaatataaataatttgtctaaaacttttaaacaaaagtttaagattcttttcttataaaaaagaatccatctcccactcctgttccaaatttgaggaaagcattattgacctggcaacaataaacagtagaaaaaaagaaatagcagaaatgggcaaaaaaatatgttctctggatatagagatgaggcctccagggggcagcaccaaggcagagaaatagactaagatcgctcagtgttttccttggtctggggctccccacagttccccaccatcactcctcccattccttccaactttatttttagctgccattgggagggggcaggatgggagggaaagtgaagaaaacagaaaaggagagggacagaggccagaggacttctcatactggacagaaaccgatcaggcatggaactccccttcgtcactcacctgttcttgcccctggtgttcctgacaggtgagggaagttaacttcttggtttctggtggggatggaagatacatagattgtttggaattgggaccattatagttaaaattctttgggatttaggttaggaagcgaacactggttgtacatttcttgtatgtgtgtctgtgtccttgtgcatttttatgccctcacatatgactgtttgaatattgagactggcaggggctaaagctgcctaggaccttgtgtaagatttgtatctaataattatataatatataattgtataattatatattatatataatatacatataatatataacaattatatattatatataatatacatataatatataacataattatatattatatataatatacatataatatgtaacataattatatattatatataatatacatataatatataacataattatatattatatataatatacatataatatataacataattattatatataatatacatataatatataacataattatatattatatagttatatattgtatataataattattattattttttaaagatagggtctcactttgttgtctaggctggagtgcagtggtgcaaccacagctcagtagttgggactactaggtacgcgccaccacgcacagctaatttttttttttgaaacagggtctcactctgtcattcaagctggagtgcagtggcatgatcatggctcactctagcctcaacctcccaggctgaggtgatccttccaccttagcctcccgagtagctgggactataggcgtgtgctaccacgcctggctaatttttttttttttagagacagagttttgctatgttggccaggctggtctttaactcctggactcaagcaatccgcccccgacagccacccaaagtgccgggattataggcatgagccaccatgcttggctgagatttgtatctaaatatataaaatcttcatcctaagccctataggggtaaggagacaaaaaagaaatgtgatgtgaccttccacgtggctagtctgattcctattatcccctccctaacttcttacccttggtggtccctggggcctgaggcataactgactaactatgtggtcagaactctgggtttatctaaccaatgagctgcagtttctggtcatacagccctgccagttttctggatgcaaaactgctcacatactaaacacctttctgaaaatgagcatggtttgggataaagctatagccattggtaatggtgagggggtagcctgagagggggttgcttagaagtacagagcaagacatagttggggaaaggaccatgggaaggacaagaggcctggaatttttccttggcagtgccctgtaatcattgtttcctaaaataccagctctgattttaaaggcattggggtcaaaagggaagattagctagggtcgggcacctttagaatgggctgaaggctgaggaaaccatggaggtaggtaggggaccagttgggagagtagattagttaaaaaggaagcaggttgtgggaaacttcaggatgatgggacccttggaaaggatggatggcaaactatgtgtgtgggcaggcgagtggccccacccagttaattaccactgagatttccaaggctggaatcaaccagggacctagacattggaaaaagacagtgagagtgtgacaatgacactggaagtcaggaagagatagagaaggagagagccagacatgcagtgctccttagcttcctttcattccccctattttggggagaattggaagcaatggttgttctggggatacagaaaggccctctccctcttttgaccctcacagtttgttgaggagagtgtgtggaaggaatgttgtggaaaagagtagccaggcgcggtggctcacgcctgtaatcccagcactttgggaggccgaggcgggcggatcatgaggtcaggagatcgagaccatcctggctaacacggtgaaactccgtctctactaaaaataagaaaaattagccgggcgaggtggcaggcgcctgtagtgccagctacacgggaggctgaggcaggagaatggcgtgaacccaggggggcggagcctgcagtaagccgagatcacgccactgcactccagcctgggcgacagagagactccgtctcaaaaaaaaaaaaaaaaaaaaaaaaaaaaaaagtaacttgaccttttcagacatgtctgtgaatgaaatttcaggggtgggaatggaaatacagctgtacatcagcatggcagagggccacagtttaggcatctggacacaaacacaggaagggaatcatctttgcctggagctctgagtacatgacactgagagaggccagaaaagcttatgagtgaaaaagcaggcaggcagactgagattaagacgcttcctcacagcttctctcgggctgtgcctctagccattcactacctcatactaacattatgatcctgaccccacaggtctctgctccccctttaacctggatgaacatcacccacgcctattcccagggccaccagaagctgaatttggatacagtgtcttacaacatgttgggggtggacagcgatggtgaggaagaaaccggagtgccaggggattgggactgcagtagtgctaacaaaggggaggcaagatagatgggactctaaactaatctggtcttttgaaagtggctggggctctaaacttaccacctccatgctctttccctttggcctatgtcaagggtcatgtttgccctgtgcttacttacattcacatcctcttcccaggatgctggtgggcgccccctgggatgggccttcaggcgaccggaggggggacgtttatcgctgccctgtagggggggcccacaatgccccatgtgccaagggccacttaggtgagaagatgcctgacccttctcctcctaacccctgactttgatactctagaagcttcaactccctatacctcagctttttcacccctaaaatccgcatactccctgtccccaatctgataccaatccctgctcattctcctccaaaatcacatgaattcaagcaccccatctatgaccccatgatctcattctcttccacctccttccaaccaggtgactaccaactgggaaattcatctcatcctgctgtgaatatgcacctggggatgtctctgttagagacagatggtgatgggggattcatggtgagctaaggagagggtggtggcagtgtctctgaaggtccataaaagaaaaaagagaagtgtggtaagggaaaatggtctgtgtggaggggtcaaggagttaaaaaccctagaaagcaaaaggtaggtaatgtcagggagtagtcttcatgcctccttcaactgggagcatgttctgagggtgccctcccaagcctgggagtaactatttcccccatccccaggcctgtgcccctctctggtctcgtgcttgtggcagctctgtcttcagttctgggatatgtgcccgtgtggatgcttcattccagcctcagggaagcctggcacccactgcccaacgtgagccagaggaaggctgagtacttggttcccagaaggagatactgggtgggaaaaagatggggcaaagcggtatgatgcctggcaaagggcctgcatggctatcctcattgctacctaatgtgcttgcaaaagctccatgtttcctaacagattcagactcctggccaggtgtggtggcccacacctgtaattctagcactttgggaggccaaggtgggcagatcacttgaggtcaggagttcaagaccagcctggccaacatggtgaaactccatctctactaaaaaaaaaaaatacaaaaattagctgggtgcgctagtgcatgcctgtaatctcatctactcgggaggctaagacaggagactctcacttcaacccaggaggtggaggttgcggtgagccaagattgtgcctctgcactctagcgtgggtgacagagtaagcgagactccatctcaaaaataataataataataattcagactccttatcaggagtccatgatctggcctggcacagtaactcatgcctgtaatcccaacattttgggaggccaacgcaggaggattgcttgaggtctggaggtttgagaccagcctgggcaacatagagagaccccatctctacaaaaataaaaaataaaaaaattagctgggtatggtggtgcatgcctgtggtcccagctactcaggaggccaaggtgggaggatcacttgagcccaggtggtccaggctgcagtgagccatgattatgccactacactccagcctgggcgacagagtgagactctgtctcaaaaacaaacaaaatgggccaggcgtggtggctcacgcctgtaatcccagcactttgggaggccgaggccagtggatcacgaggtcaggagatcgagaccatcctggctaacagagtaaaaccctgtctctgctaaaaacacaaaaaattagccgggtgtcgtggcgggcgcctgtagtcccagctactcgggaggctgaggcaggagaatggcgtgaacccaggaggcagagcttgcagtgagccgagattgcgccactgcactccagcctgggcaatagagcgagactctgtctcaaaaaaaaaaaaatgttctctacccacatgcctttcctaatattctcttctccttaaacattttcagtcttcatagttgctaccatgtttcattcctcaccatcagaaccactctgcttttgttcccccaccatacagtcattgctatgttcctacatagcatttaattccttcttgttttttagaacattgtatatataaattatatctatgtatataaatgtgtaggtgtgtgtgtttatatacctatatatacatatatacatatatatacatttatatgtatacttacatacacacaattactaaagattactaaaggaatattttattaatttctacacttacacagagcctggcacagtaccttctttgcatgtaagaagtgccttataaatgtctaaattgaatgtgtcctcctgtgacctctttcccttgttgcccccagctcagtgtcctctacctcagtgttccccttccttctaggctgcccaacatacatggatgttgtcattgtcttggatggctccaacagcatctacccctggtctgaagttcagaccttcctacgaagactggtagggaaactgtttattgacccagaacagatacaggtaagagaaggcaatatgagctgggcacagttgcttgtggcacctacttaagaggtggaggtgggaggatcccctgaggccaggagttcaagactagcctgggcaatacagtgagacctcatctctaaaaatatgaaagaaaaaaaaaatagccaggcatggtggcatgcgcctacagtcccagctactcaggaggctgaggcaagagatcagttgagcccaggagtttgaggctgtagtgagctttgatcacacaactgcactccagcctgggtgaaagagtgagacctcatttcttagagagagagagaaaggcaatatggatgggcttggaaggggagagacagagagagaggggataaatgtaggtgttgtcttcagtagtatccaggtgttcatctctcctctcttatatactttcttcttcctcctctccccccatctcacatacatacatttcatttgaatgcgctttattcccaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctggtgaggcattgggaagacaggtgtgggaggctagagcaatgaaggcttagaagagttagggcggggccaggcatggtggctcacgcctgtaatcccagcactttgggaggcaaggcaggcggatcacctgaggtcaggagttcgagaccagcctgaccaacatggagaaaccccatctctactaaaaatacaaaattagccaggcatggtggcgcatgcctgttcagaggcatgctacttcggaggctgaggcaggagaatcacttaatcccgggaggtggaggttgcagtgagtcgagatcacaacattgcactccagcctgggcaacgagagcaaaactccatctaaaataaaataaaataaaatgaaatgaaaatctttcccttaaaaaaaaaaaaagaagaagaagaagagttagggcaggtttggagtgcagtgtgtatatcccaagatgtcttgcatactttctttgtatgtacactaatggtacaaagaggaaggctaagtgggctgtcattgtactccctctcactgcatttctacaaagtatctatgtctgtgtctctccatatttcacagacagaagtctctttctatccctccactccaacaatgatcctggcccacaggttctccactactgatgtcctagcccacgttccaaacatgatccaaaactcatctctaggggcacggtggtaaaattgaaacaaaacaaaacaactcatctctgggaggagtccctgcccagatcattcttttccgttctatatttcatcgatatttcccctcccaagtgcaatatttgttgaatgaatctgagtgtatgaacgttgtacttatttggactgataagctactctgtatgttctatgaccttcaaacatttgagctctcactccatgccatctccatgttaaatactcaggaaatggcctaaaaggcaagatgcttgacctcagggaagtgctgatgttaaatcctgtgtgtgtgtgtgtgtgtgtgtgtgtgtgtgtgtgtgtgtatgtgtgtgtgtgtgtgtgtgtctgcatacatctgatctcacctcactcctttctcttctcagcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtgagaattcaccctggatctggaagagttggggagtggcaggggggcagtgtcttgtgaactgtccaaggactgggaacttgaggaaaacaagggcattaactacttcccagacttcagccacagcatgttagttggctgtgttctgtaccaactctaatgcctcattccttgatcttatgacctcttaggtccttggtcactacctccggcggcagcgagatcccagctctttcctgagagaaattagaactattgccagtgatccagatgagcgattctttttcaatgtcacagatgaggctgctctgactgacattgtggatgcactaggagatcggatttttggccttgaaggtgaggattactctggagaaatggacagggcgggagaagttctggagtgtaggtggggctctggagtgagttcagtaggtcaaaggggaaactgtcttcccctgatattgtctcaatgttttctcatgaccaagggtcccatgcagaaaacgaaagctcctttgggctggaaatgtctcagattggtttctccactcatcggctaaaggttggacagattgaccccttcattacttctcccattctctgactcagataacttcaaccacagggccctccagattcctcctttaaccagcctccatgctcaccttcccatgcctttccaactgagcccagcagaccctcagtgatcttttcactcctggaacgttttttttctctttattccccactgtcttctcagtgaccccatctgcttctgtcccacaggatgggattctttttgggatggtgggggcctatgactggggaggctctgtgctatggcttgaaggaggccaccgccttttccccccacgaatggcactggaagacgagttcccccctgcattgcagaaccatgcagcctacctgggtgagcagcagagagttgcagaggacttacagggtaggggaggaaatacatccctagtgggggcgggtatgaaatactccctcttaactcatgcggtttctcactgacctctggttacttcccttgggacctcctgctatgcctttagggaacccccctactctggaccccatcttcttttcctttacctctgttactttgcccacttctaggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcaggtagggcatccaaggaagggtgggacctttggattcccagggacctctgggctgttggggaggagtgtgaagtgggtaagagagaggcctccaaagtctgtgcggaattctggttggcagagtctgtcagggatgtaaggagcagactagcaggctggtgagtgcttcccactgagtccacttgtctacagttaccttcccttttctctggggtcatcatcacccaccattccccagattggttcatactttggcagtgagctctgcccattggatacagatagggatggaacaactgatgtcttacttgtggctgcccccatgttcctgggaccccagaacaaggaaacaggacgtgtttatgtgtatctggtaggccaggtgagacttgctgggaccccctgccctggacttgcattgtgggggtggagggaggaaaggagggaaggtgcacatatttgagggtttgctgagaggttgggtctgccagattagcatcttctatcttctctcctccaccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccaggtcaggagtacccaaataaagcaggggcacggttgtaggaagaggaatagggggatgctctttgcttgtcaatagtctccttggcttgagacccaaactgaacaagtgcttttattagtaggcaaaaacataaggcagtggacaggttgctgaactaagaactcctgaacacaggcaagtttctcttattcccaggactgacgggagcattataaagagcaaggcatggccgggtgtggtggttcacgcctgtaatcccagcactttggaaggctgaggcaggcagatcacctgaggtcaggagttcgagaccagcctggccaacatgatgaaactctactaaaaatacaaaaaattagccgggcctggtggcgcacacctataatcccagttactcaggaggctagggcaggagaatcgcttgaacctgggaggcggaggttgcagtgagccaagatcacaccattgcactccagcctgggcaacaagagtgaaactccatctcaaaaataaataaataaataaaaagaaagagcaaggcaggaggcctgagaaactaggtgtatgggtccctgcctcagtattctctctcttcctctcagaggattgctgctgcctccatgccacatgccctcagctactttggccgaagtgtggatggtcggctagatctggatggagatgatctggtcgatgtggctgtgggtgcccagggggcagccatcctgctcaggtgaggggtcccagctcaggtggtggtggacagcatagcatagctgttaaaggcaagggccttaaagtcacagatggagatttggttttcttggtcaacttactctgtgcctccattcttagtttataaaatgacagtagtaatagtacctaccttataggtttattgtgaagattaaatgagataatccatataatgatttgaacacagtgcctagcatgtaagtgcgtattgaagtgaatctagggctgggtacagtggctcacacctgtaatcccagcactttgggaggcgaaggtaggaggatcatttgaggccaggagttcaagaacagcctgaccaacatggtgaaaccccgtctctactaaaaatacaaaaaaattagctgagcatggttgtgggcaccagtaatcccagctactcgggaggctgaggcaggagaatcacttgaacccaggaggcagaggttgcagtgagctgagatcgccccactgcactccagcgtgggccacagagtgaaactccatctcaaaaaaaaaaaaagatcaatgacatgaatctattatcttacttctgtcagagggttcggggtagggtgacatgtgcattcagcccctccttctttgttttgaccatggggaagcaaacactgggcttgcacttctcagagggcttacctcctactgctagaatttcttttccacactgttcccagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctgtgagtgactaaaatgcattacaggcaactctcaattccttgcatgccttcctcactagacccctttccaccctcactcttgcctccttcattcagacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggtaaggagagggcagtaactgcttagcatcagggcctgagaatgaggagaaagctgggtcagaggaggaattttagctgaatcagcaagaaagccaaagccgggaaaatgagatgattcagactttggagtcagggctgatctgggtttgaatcctagctctgccatttaccacctatgaattctggcaagtccaaccctcagttttcttgtctgcaaaggggtgataataataactgtatcataggagttgtattaaaattaaatttagccgggcgcagtggctcacgcttgtaatcccagcactttgggaggccgaggcaggtggatcacaaggtcaggagatcgagaccatcctggctaacatggtgaaaccccatctgtactaaaaatacaaaaaattagccgggcgtggtggcaggtgcctgtagtcccagctactcgggaggctgaggcaggagaatggcctgaacccaggaggcagagcttgcagtgagccgagatcatgccactgcactccagcctgggcgacagagcgagactctgtctcaaaaataaataaataaataaataaattaactaattaattaaatttagtaatacagttaagatcttaggacagtgcccagcacacagaaaatgcttcataaatgatcactacaattatcacaagatccttgactctgtgactctgtgactctgttttccttcaggatacatcagattacctccggccagtggccttgactgtgacctttgccttggacaatactacaaagccagggcctgtgctgaatgagggctcacccacctctatacaaaagctggtcagcagtgccatgccctgccccttgctcccaacactgccctccttcaagagaaaagggagggagggagaagacatgagatcatggtgaaatctgacctgggctcctctaatcaaaatatacccacttttgtcttttcactttccccctattctattcctttcctccttgctttcctctcaacccttagccccttccctttcttccaggtccccttctcaaaggattgtggccctgacaatgaatgtgtcacagacctggtgcttcaagtgaatatggacatcagaggctccaggttggatggacatgtactaggcaaaccagggtgacctgagacagactggaagggactcgaagggcgggtagggggttgtttcttacccatgataacaaaagtgagacttttggcactcccctccttcaactcctggtctctccctcattcatcattcccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcaggtgcctttggaggagggggtgtgggagaaggaaagaaaggaggaggaagaagattggggtattggcctcagctgtgaggtcctctagagaaaggctcagtgtttagaggctgtgggtaggacagcagttgcagccccagctccagcttctatctccattcccctgccctcagagagagagcccaataaaggtggaatgtgccgccccttctgctcatgcccggctctgcagtgtggggcatcctgtcttccagactggagccaaggtgggttggggtctaggatgaaaagagggctctaggagggcagaggctgggatctgagggtcctgggacttcagggaagggggcgcacaagggctcctgttcctctgtagttgttccatgaggaagactctaccattaccctgtgtcccctgcccctaggtgacctttctgctagagtttgagtttagctgctcctctctcctgagccaggtcttcgtgaagctgactgccagcaggtgagaatgaagggaactttcttccagacctctcctcctactgagtcttgactggaggggtggggaggaacaacattgattcctctattaacagagaagggtgtcttctgaggaggggttgagatgtgagcctctcccctctgaccctacagtgacagcctggagagaaatgggacccttcaagataacacagcccagacctcagcctacatccaatatgagccccacctcctgttctctaggtatgcccagcttctagggtgggacccagttctgacctcagactcatacccttatgctgcttccctccccttccatgtgcctcagtttttccaaaaacccaagcccttgcggctgctcagtctttttgccctcaatcctattcatgctgaatcttcccttttaagcatcttactttcctaggtatagtgttttgccaggccttgggcactggagctgggatgaggggatatgggatgtagccataaagcttgcattgtctgtgtcatgttctacttctgtcttctccatgtacccccacctctttatccatgtgctggccctgcctcctctgaatccacgtctgtgtgctgatcatatgcccctgtgtctgtgttatggctgtgaccatgtacttcctgacttggtgttcacacagtgagtctaccctgcaccgctatgaggttcacccatatgggaccctcccagtgggtcctggcccagaattcaaaaccactctcagggtgagaagctggaggggtcttggcatgaggagaatgtgggggaacaacagctttgtgggaaaaggatgggaagggtctctcttggattttaatggtatctagggtgaaggggaacaaatgaggaagggtcttctgtctcccacttcttcctattcccaaccttcctcttaggttcagaacctaggctgctatgtggtcagtggcctcatcatctcagccctccttccagctgtggcccatgggggcaattacttcctatcactgtctcaagtcatcactaacaatgtgagtctggtctaggagggcatggaatcctgccaccttgagctggtggactcactgaagctggacaccacaccagctccctatctgttgggcctctgctcttggggctcttctctctggggggctttctttttacacatgtggcttattagagagaagaaaaaggtattataaggggaagaactacaagggtgtaggtatgttccaactcagccttgagtggctagcgccaccccatcaggagggtctttcaagttggatcttcctctaggcaagctgcatagtgcagaacctgactgaacccccaggcccacctgtgcatccagaggagcttcaacacacaaacagactggtatgagtcacaaaggggtgtccagagtgggaatgcaagtggagttgggtgacttgggacaagagggtaggaactggagtggggaagaagggatctttccaccccagggtcctgatctggagtgggaatgaaaatggagtcaggtgccttgggacaagactgtgtgaactagaggtggggaaagaggatgtttctaccccagagtcctgatctgtctctctctgtctcttctgttagaatgggagcaatactcagtgtcaggtggtgaggtgccaccttgggcagctggcaaaggggactgaggtctctgttggactattgaggctggttcacaatgaatttttccgaagagtaagcctttccttttctagtactccccacttctgctcctttctggaactttagcataggttttggaggtagacagacccacgttcaagtttcacttttgcctcttactagctatttgaccatgagcaagttatttcatctctctaagcctctttttcctaatctctaaaatgggaagataataccaatttcatggggttgttataaagaataaatgaataatgagctggacatatggtgaacactcagtggaagctagttattatccttgtattttcctccactgaccattacttttttttttcctgaccattccttagtgctgtatcaatcaacatttgcaggatacctaaatttaatcagttaagaatccatcacgttcctattacgtaaaaggccctgtattaggttgacactgagaatatctccaacatttagcctcatgcctaactcattgtaggcgcttaacatatttttgctaaatgaatgaattattgatattacatgcaggatttgtactggggagtggtgggaagtaagattgtataggtgagagggatctagattacgaaaggcctctgaagccagggagaaactgaacttaatatgacaggtagtgaggagtcagtgtgagttcctcctgggcagggaaatggcatcttaattgtaatggctgtttggcactaaggtcaatgttgtgctttcccatatctacctggaataacacaagatccctgggatgtcatcatatgttttagggaagttaagtccaataaaccacccttctccaagtctctgtccttctttggtatctttttttcactagtctattcatgctttcaacaaagatttattaagaaaccactacatggccgggcgcggtggctcacgcctgtaatccctgcactttgggaggccaaggtgggcagatcatgagatcaggagatcgagaccatcctggctaacacggtgaaaccctgtctctattaaaaataaaaaaattagccaggtgtggtggcaggcgcctatagtcccagctacttgggaggttgaggcaggagaatggcattaacccgagagatggagtttgcagtgagccgagatcacgccactgcactccagcctgggtgacagagcgagactccatctcaaaaaaaaaaaaaagaaaccactacatacttggtactctgctatctagtaggcactaaggacacaaaggttagtaaggcacagcctttaacctagaggatcttatagttcaggagtgaaaaacagaagtaaacaccagtgttggtgggggttaggaggaatgatttccctaaatcccagaggggatgacatctaaacttcaatctaaaggaggggtagaggtcagccaaaggaaagaggagtagaatgcatttcaggtaaagcaccagatgtattgattgtccttggaaaacaaacagcagcagcagatgtgaccaggggttttccatctattacccttcctctcttttcccattggtcttcagccttttcttctggtcttgagagccctcaacattatgcctctcagcctcaactttgctgttgggattccaaagaactatatcacctgataatggctcattttaaatgtcttcctatccacttgttccataggccaagttcaagtccctgacggtggtcagcacctttgagctgggaaccgaagagggcagtgtcctacagctgactgaagcctcccgttggagtgaggtagggctggagaccgagtctgagagctgtgaaaataatgatgatgggtatgtggtagggccacccgtgggctttttcagaacgaaggcatctccatcaggcagcaggatcctagtgttccactgccgccattcctgcctcagtttctttcctttaagtagcaggaggttatttattctatttgggggctggctttgatataatgtggggtgaggctagctgggttataggatgcatgtagaaaactactcttctgtccacgcagagcctcttggaggtggttcagacccggcctatcctcatctccctgtggatcctcataggcagtgtcctgggagggttgctcctgcttgctctccttgtcttctgcctgtggaaggtaagcactgctttagtggggagtgtggagcatgatgcccatgagttgagggatccttgattatagcagagagaacaggatttgtgctgggcagctaaccaggctgtggatgtcatgcccagatctccttcactgtaccccacaaatgttggttaaattattctaagccaaataaaataaatttgaattccatttttggaaacagaacaaaagtgaagacctcagataagtctgagagctactggcaaggttcccagtctaggcatttggcagtgacgcttatcttttcttctacagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatgacttttggctctatatgtattccctaggatatagactgctcagtaatagtgagaggtagatacttgttttgcctgggattttacagagtggagtccctggaaggcaaagttaagaagtattttaaatgttttctgtggctttcccacaggagatgtattctagcctcctgtaattctcacctgcttaagtgaccagaaagtataaaggtctgggaagcacagaggtttagattgaaatcctatctgccatttattagctgtatggccttcagcaaatcataacttccttgaggctcagataataaaaggctgtgtattacagtggttaacaatgaaggcagatttgggtttaaatctaggctacacaacttaaaaagtctgtttgacctaggacagacttaacttctctaagtcttggctttctcatctttaaacctattagggtcatgaagacaaaatgaaataatccaagaaaagtgagcatttagtaaatgctcagtaaatggtaactattattataaaactattttgtcataaaataatctaccatatcatgccttgtgaggattaagggagaaagtatactggagcaccaggtggtggtgttcctgctctctgacccatctcccagattgtgaagatgtgtttctacgtgctgttgtctcatccactaaatcttgtcctatgcctcatcttttttttttttttttttttttttttgagacagagtctcgccctgtcgcccaggctggagtgcagtggcacgatctcagctcactgcaacctctgcctcctgggtccaagcaattctcctgcctcagcctcctgagtagttgggactacaggtgtgcaccaccatgcccagctaatttttggatatttagtagagacagggtttcaccatgttgaccaggctgatcttgaactcctgattcacgtgatctgcctgcctcagcctcccaaagtgctgggattacaggtatgagccactgtgcctggcctgcctcatcccttttgaaataagctctttgagccctctaaggtgataattagctgaagaatttaaggttctaatggtagagatcaaatctatttgattccattaagcaggtatcttctaggctcctcttgagacacccagagtttttccattatcctgagagaacacgtgcacttaagcaatggccttctagagaccgagtctctgcctctattgcctaaccctgagaattgtggcctgtctggcctatttggcatgaacaccattctgtgtcaacctgctgagttgttttgtgacaggaaagggtttccattgtgaccctcagtgcacttcatacaggctgtaacttgatcagcctttatggagcacacagtttctagggctgagaccgcaaccagattatgttgacagactctcctctcctctttaccctcagtcagcccccaaatggaggtaggtttccttgagtactggttcatctaatgctcacacatatatacatatacacacatatatatgtgtgtgtgtttgtgtgtgtatacatatatatatatttaaattttttttagagagggggtctcactatgttgcctaggctggtctccaactcctggcctcaagcaatcctcccgtcttggcctttccacatgctgggattataggtgtgagccactgtgactgacctcatgtaattcttttttttttttttttaggattaatttcttttatttatttatttattttattttacttcaagttctagggtatgtgtgcacaacatgcaggtttgttacatatgtatacatgtgccgtgttggtgtgctgcacccattaactcatcatttacattaggtatatctcctaatgctatccctccctgctccctgacctcatgtaattctttatccatatgattaagagagcacttttaatatatttttccaactagagattcccctcctatccatcgtcagctccagactggggctttctctaaacccaatcttgttacccctttctttgcaatagtattagtttaagaagcaactgtgtattgttccttcctttccttgttgttgctcctttgcttcttcattaatttttttcattcatttattcatcagatatcaagcacgtaatatgtgcttgacaatggcaataatataaaacacaactaccatcaaagagtccagtccagtagcagaaacaaacatgtaaacaaatagtggcaaatacagcctggacgcagtggctcacacctgtgatcccaggactttgggaggtcgtggcaggtggatcacttgagttcaggagttcgagaccatcttggacaacatgtgaaaccctgtctttaccaaaaatacagaaacaattagctgggcatggtggtacgcacctgtagtcccatctacttgggaggctgaggtgggaggatggcacgagcccaggaagtggaggttacagtgagccgacatcacgccattgcgctgcagcctgggtgacagagtgagacactatctcaaaaacaaaaaaaaatggcaaatgcaaagaggtggttgctatatatcaacaagcactaggagtatgtcatacaagaggcatactttgttgggcggtgggggtggcggggttgtaagggaaaactttatagaaaaaagaaatttggctgcggggttgttctgtgcaggaaacgcacaaggggagaagaagagacacacacaatacctttaagggtaaacaagctttatcccatgtaaatggcaatggagatataataagcaaatggtacaagcaaattaatataataagcaaattatataataagtaagcaaatgatataataaacagattgatataataagcaaattgcaatgggaaggggagaagggaaaagatgtttacattcaccagactatggaggatttaccaccagactggaaagcaacagcctgggttccagagttgaacaccgcactcataagactatagaggattcaccaccagactgagaagcaacagcctgggctccagagttggccactcatccatgcacagacgaggagaggtctcatgaagttttggcgcagtctgggaccctagctctttttgtaacgagttgtttggcatgaggcccagtcacggggcccttggcgactgggctcaaggaacacaaaacattcaacttatttttgcaattgtctattgtttttcaataactaacgtgtaggaatagattgaaatagagatttctccaaaacagtgctggacgaacacctcaaggggctcacacaacctgttctgggacttggtgaccattgtttctgtccacgttcaattgagttcaaatttaatatttaacttttccaccgcagggatcaaatgtgacaggaggcattcttgggaggattaatcaccagctgcaaagggaattgtaaattagaacagtttgaggcctggtgctctgggagttgaggtgaggagaatcgcttgagcccaggagttcaaaaccagtctgggcaacatggtgaaaccccatctctaccaaatatatgaaaattagctgggcatggtgatgtgcacctatagtcccagctactcaggaggctgaagtgggaggatcccttgagcttaagaagtcaaggctgctgcagtgagccccgatcatgctatcacactccagcctgggtgacagcgagaccctgtctcaaaacaaaaaaaacaaggccaggcatagtggctcacgcctgtaatcccagcactttgggaggccaaggcaggtggatcacttgaggtcaggaatttgagaccagtccggccaacatggcaaaaccctgtctctactaaaaatacaaaacttagcgggcgtgatggcacatacctgtaatcccagccacttgggaggctgaggcaggagaattgcttggaccgggaaggcagaggctgcggtgagtgagccgagattgtgccactgcacttcagtctgggtgagactctgtctcaaaaaataaaaataataataataaaaaaagaaacagtttgagtggctcttttgtgtgaaagtaatgagagatgggactgggaaagagggcggcagcgtatgactcctgaagagccttgtaaaccacttaagaactttgggctttaccctgtaggttttcatatgcattttagtgagctctctccggcggggagaggagaaaagaaagacaggaagaccagttggctgcgactgactgttcaagaattaccaagagcctgaacttcaagggcagtggaaataatgaagacagttttttgtttggttattttttgtttctatgcgggggcgggggcggggggggcagcttaaaataaaattgctctcctcgctctctgctgttttctaattcagatgtgcgtttaaaaattgagcctgggccaggaatagtggtggctcatgcctataatcccagcgctttgggaggctacggtgaggagaatcgcttgaggcctggagttgaagaccagactgggtaacatagagacactccatctcttaaaaaaaaaaaaaaaaaattagccaggcgtggtggtgcatgcctgtagtctcagctactcgggaggctggagtgagagaatcccttaagcccacaagttggaggttacggtgagctatgatagcgccatgcactccagcctggccgacagagggacagattagagacactgtctcagaaaacagaaagaaaaaataaaattgaacctgatcacctttccttaggttttgtcccccaggttaccgtgggccgcgcattatctctgctctgcttaacactacaatctcctatttccgaactgctctcttcaaatgctcttttttgcttgggtttttggccggggaatagtggcgggggagaggcggggggagttggcgggggcagaggtaactttaccagtgattaaatgcaaatgcgacagtccgtgagaccgaagcccctggtagaagccgggaccctcctgcctctggctgccgctctccgaggggcggggctgaggcggggcttggggcggaggccccgcctggaactgagggtggggcgggtccgggtccgggaggagtctcagctggagcccacccggttcctttcctgattgagcaggtcggatcccagggtgggttcagatttgaagggcgaggttcgaggccaagcccccgtcgcagcctaagactgcgggcttttctcctctgcagggatggggtagggcagggccaggggcggagttttgagcccagcccttgggttcttgcctctgattgagcagggcgggttctgaggcggatcgtggggcggggcccgctctgctttttgacagctgtctcttgcacagccgcagccaagtccggtgggttcgggaacctgtggcccggctctctgcgcgtccccatcccccgtggccccgaccccggccatgaagcgtatcttctcctgctccagcacacaggtggcggtaggtgccaaaatgtgtgggaggatggggttgggatcccagctctgtggtgacagaagtctttagtcccgtctcaatgcatcatcgccttttctttttatcagtctttctagctcttctagtcttgcaaggaagcccgccagctttgccttcctcaagaccctgccctgcagcttctgacttgccctgctcacctctgccatccccaaggccctttccccggcccctttcttgtcctcctagcatctacacccccgatttctggttcgttttctgcaactctgtccccttcccatggccctgaccctacttctgctccgtctcccagtaccaaacctcccccaagcatcttcctcagcccctgcctggcctcaagctccattctacaccaccaagtcatgccccagagccccatatttcatccctgccctgtccccgcaatcttgccttccacgtagctctatccttgctgtttcctgttagttcaacaagcactcccagccctgtgccttctgctaaccctttttcacaatctcctctgtcattgcttccctcctgccccatgccactttcactcccatctctcaccagcactgctgttcctcaaacatcactccaaacctttttccaattgatgctcccacaacagcaaccttctgttctcccctccaacctctgccctactctgcccagtggtcgccagtcccacttttcctcctgcctgcttgctgtgagttaatattgcagtctggtcagcctcacaggcactgccagaggatgcacagttgcctgactgctccccagaggactgggtgagttgcctgcagagtccaccccagccagttcactgcagtgtctgatcatcagactggttcttgggccagtcaaggctcaaggcctttctgcctgcttttccccagattattcatttcctgaacccttgcccagttgcttaggaatgatactctctgtttcctttggttgaggtgggggaaagtgatgatgagagaagaggatagagcagactcagagttcccagcagaagtcactctattccccatgttctcccagaaaaaaaaaaacataagattatagaaggtggtggcttagggagggtattgcttcttcttctctagagatctcttacagagagcccccttatttggaaatggaattttctgtagaggttggggttacggctaatttagaagcaaattagccagctacttgtagcaatattgctttgctaacttgacttagtagtatcgttcataagaaaatatcagaaatgttcaattagctcattctgcatgggcaggttacagaatcctggaagcaagctatgaggcaagagtatgaactctgttgaggcctgtccttgtcccacttacatttgcatctctacttagtttccacacattgatcaaccaatcaaaaggtatttactattatatgcaccagaaactgaggctgcccagactcagtcttaactcataatgactttttagaaattcatatggactcttccttagttactgaaagtattcaatgttgcctttcccttacaggtttgtggagtctgcctgcttcttaggaatggggaaactatttcattctttctgatcccccaatccttgggcagtacctcctttccaaggtgctggaatgagtgggctggcttttggaatttggaaccatccctctgtcctccttgattctagctgtacagaggtttgaccataaagaatgaccacccattctaaacttttagtataacaagatcttactataatgagattatgggaagtaagttggatgggtttagaattatctagctggaaagaaaactgtttcttcagacagattggagtcatagaaagcttgcaaatagggcagtttcagctgcagattggttcctcatgaaatttccccacacttctcatgataaattcctccactgttttgggtggcaaactactctggaaccatttgtcagagaagtagtgtggcagtctttatggccactccaaaagcctggcttcccagtcacactggaagactgcctctacccatctccactcacacatttgggtccagggccagagccctgcactgtcagtctgagtaaggactgaaaaagcagtgatcattttaaagctaatctaagttaccagtatataggaaaatccacacacaaaaaaaccccaactcctataatcccattttattttagtcaagtagaggatatccttgagggtatcttacctatgagcttactctgcctaggtagaccagaagtagaccagaagagagctttaaataattggcactggatcatctgggcgcagtggctcacgcctgtaatcccagcactttgggaggctgaagcgggtggatcacctgaggtcaggagtttgggaccagcctggccaacatggcgataccctatctctactaaaaatacaaaaattagccgggtgtggtggcaggcacctgtaatcccagctacttgggaggctgaggcaggagaatcgcttgaacccgggaggcggaggttgcagtgagccgagatggtgccatcgcactccagcctgggcaacaagagcaagactccgtctcaaaaaaaaaaaaaaaaaaaaaaaaattggtactgtctactgcaattacaacgttgagaattaggtcctggttcccctttctgtttccactcacctgacctacagcagaagtcattccttctctctctacttgctggtgtgcttccatgttataggatgcttataggtacacagccagagatataaggagaaggtacaattacttctacaaaagtcctctaatctcagctatggaaatacaaagcttatacttattgagtctgctgattaatttggtgattgctcccttgaggctgtgatggtaatctagtgcctcctttccaaggtgctggggtaagctacagactggatcttgacatttgaaagcatctctctgtcctttacttcagctctgcagaggcttggccatgaaaagtttctacccattctaaactctacttagtataatgagattataggaagtaaattgggtggatttagaactatctagctggaaagaaaagtacccaggccaggcgtggtggctcacacctataatcccagcactttgggaggctgaggtgcggaggatcacttgagcccaggagtttttgagaccagcctgggcaatgcagtgatacctcatctctaaaaaaaaaaattacctgggtgtggtagagcatgcctgtagtcccagctactcagaagactgaggtgggaggatcacctgagcccagaggtcaaggctgcagtgagccatgatcatgccactgcacttcagcctgggcaacaaagcaagactctgtctcaaaaaaaaaaaaaaaaaaggaaagaaagaaaaagaaaaaagaaataaaaagaagtggaaagggccaggcgcggtggctcacgcttgtaatcccagcactttgggaggccgaggagggcagatcacgaggtcaggagattgagaccatcctggctaacatggtgaaaccctgtctctactaaaaatacaaaaaattatccgggtgtggtggcgggcgcctgtagtcccagctactcgggaggctgaggcaggagaatggcgtgaacctgggaggtggaggttgcagtgagccgagaccacgccactgcactccagcctgggcgacagagcaagactctgtctcaaaaaaaaaaaaaaaaaaaaaaagaaggggaaagaaaagtatctatattgctaagaagcatctttaccatctgtacagcttggctgttattcgctggctagtatcagcaagatcccttccactctcctggctggagaattctgagcccaggaacatctaaaatgtgctcaggaaggatggattgtgcatctactatgtggcagacaccgagctagatgccttataggttgttatagtattaggaaactgaggttcagagatgttgttacatgcctaaattcacagaggcagacagtgttagagtcaagacttgaaacatttcgagaactgcaggttgacgtcagctgatggcagcaccctgtcgtggggcatagttctagctctctgctttcctgggggtgacctggtctccaaaggccattagaaaatgcgttcttacatgtcagagtctgttagtatgtgaaggagtcattttgcttattttgtcctttgagagttaacctgtttggagactccatgagacagtagagtctgagggtgggtggctttgccctggaggcaacttgagactgtttatctggaaataagtaaacctgtttctatagcttgtagtagtgtggtctggtggggagagctaggatttggcatcaggtggactgggttctttttttgtttgtttgtttgtttgagatggagtcttgctcttgtcacccagactggagtgcaatggtgcaatctcagctcactgcaacctccacttcccaggttcaagcaattctcctgcctcagtctcctgtagctgggattacaggcaccggccaccacccccagctaattttttgtatttttagtagagacggggtttcaccatgttggccaagctggtcttgaactcctgacctcaggtgatccacccgtcttggcctcccaaagtgctgggattgcaggcgtgaaccaccgcacccagccatggcctggattctaattccaattttgccactctttttcgtgatcttgaatggttatctaatcttggtatacttctgtttcttctgtcaaagagatggaataatagccctagctactttccagggatgttgagagactaattgaaatagcatgtgaaaggactgtgagaagttacaacttctgtacaggagtattacctcagaatccatctaccttagataattttatggtttggatatttagagctttcctgtggttgattaataatttgccctggctacgtaaacagtgtttgaaaatgagttactgggcttccacagaccctatttttcttcacccctttctatagcctcttgttgagattataccttataaaatgctatgtgccaccaccaacaccccactacttcctgttttgttacaaggatgccatatatttgtatggctctttacagtttataaagagattttgtatatattagcttgtttaatagtcacagcatgatgaggtagttgttattagccgtattttatagaagaggaaacaggttaaaggtgtttaatggcttactttaggtcacatagccgagaatgtagctgaactaggtcccaaactcaggccagccagcgaaatatttgtctggcagcctttacatcagaccacagatctttgcatctgtctcttccttttcattcccttctctggacaaaaccaggcttttctgtactttcagccctgggtgtttttacatagctgtctcttttatgccctataacacttcaattattataattaccctaccacccacaaaacccaagctggaatgatagaacaatgcatgcccaggtgtggctgttgtctagacagctgctccctgccagggaaactgggagggaggagaaggggagctacctcttgctgcttcctcaaacataactagaaacctctttgccttttggttgttgttgccatggaaaggagagagacggtcgccaaagggcctagatatgatatgggaaaacagaaactctagtttcctcttttaactgtggggcccaaagccaatgaaaagaggtggaatggttaggtattggaactcctagctgtaacctgaagctcggtcggtgccttaatgtacttctcaaacaactgacaacaaaaagcagagcagcagggtttcaggggtggaggcggtggtgagaggcaacatgagtcctcaaaagtggtcacgttggttccatttgctccagcaagacctagagagcaaaagggaaaggattgctctgaggttgggcactgaacaacaactctaatcatgatgacaaaaggacatttgaaatactgtgcattcagcactcaaatgatttttaattcagtggtccagggtccttctggctcagggctggaaataaccagcaatagttcttggtggcatattagctggttaagatttagctaggcccacctaagaaggactaaatgatctaggatgtgtgacttgtggaagagaaaaagggatgttccttttctctcatttggcatcctaaccatttgcctcttttctttctccacactacccccatgccctatattcacacaacctgtggctctggaccaggtggagagatggaaccgccatgatcagaagctgctggaggcagtgcacaggggggatgtgggacgcgtggctgccctggcctccaggaaatctgcccgacccaccaagcttgactcgaatggccagtccccgtaagtcagtcctcctgcccctgccccttacatgtggctcccttttgaagcccccaaatccaatataacataggaccagggaatgcctacaacttcagagctcttttcattgtcttaattagcaagtatatcaatagttttttgctacatataagttctacacaaagtgaggaaagaaaatattgttcctgagctccatccattgcacaacccagattgacaccactgacttgtaaagtacataaagcccattaaacaaacagaaaatgaatatatacactaagtagagtgtttcttcattgcacaagtaggagggtgtgtatgcatgggaaatttgaaatgaagtggtagcatgggagtcacatggctagagggagtagtgattaagtcaaaggaaatgttatcccttgtctctacccaaagccttcgaatgtccagccttcactctgctctggctgactctttctgtgacacttccacttccgctaaggttctgtgctcagagaggcaggtaattatgtgttccctagacacccctgcaatagtctgagattccttgagacctgtagctcttatttcttccttgcttttagcatcctttgtgattggaggccatatagacttctctttctcagaaattcaagctaggggagcttcttttcctgcttttaggattggctttggggtagggagcatagcaagaagggcttatcaagattctcccattcctcatccctggtccctttatcctttggcctctcggccttgattctggcaggtttcatctggcagcctccaaaggcctgacagaatgtctgactatcctgcttgcaaatggggctgacatcaacagcaagaatgaggatggtgagtgagccggagcactgggccacgctgcttgcttgcccctggtacagcagcagtcgggggcggtgctgggccctgctggacattcctactgtggccccttgcttctctccttagtaagttctggccagcatccttccaggagttcccctccccgtaagctgggcacacctcacccccactcccaccttcatcacaggtaccaggcacttggggaacaggaatttctggccccgtgtggctgaaagcttctctccctaatctcctgattatctgtgcgtctcttgccttccctccctgtgagtcatcagcatgcatggggccacctaccctccttctccccttctttctgttccaggaagcactgccctacacttggccaccatctcctgccagccacagtgtgttaaggttctgcttcaggtaagagcagtcccttgataccactcttatgaagggaagaagtggtcccagagttttctaacttcatttcatacttaaaaggaatagttggccaaatgtactcgcctcatccccaataggagggctgataatcatttgtttgccaacatttatttaactactatgtgcaggcaccatgtttgatagtgcctttgagggcaggttataaagcagagttgccaggcactatcgattttgtcattagcagagccactgcagagacttcctgctatgatgaggggcaagaggaaggaggacagagatgttcaaattaaaccaaagccctactgtctgtttctgaagagtttatagtctagtagtataaagagaaatatacatgtaaaatgacatgtggatcatttataaatgagtctccaaaagcacaaaaggcagttactggccgggtgcggtggctcatgcctgtaatcccagactttgggagatggaggtgggcagatcacaagatcaggagatcgagaccatcctggctaacacagtgaaaccccatctctaataaaaatacaaaagattagctgggtgtggtggcacgtgcctgtagtcccagttactcgggaggctgaggcaggagaatcgcttcaacccaggaggcggaggttgcagtgatccaagatcgcaccactgcactccagtctgggaaacagagagagactctgtctcaaaaaaaaaaaaaaaaaatcagttatcttaaccggccatcaggcaaatggatgttctactttcgttcttcctaatcctttccaaatttcacaattatgtttctaaagtaccagccacggggacattgggtgtcattttccctaacacgtttattaccatctgatttttcttagccccttggtttagaaaccagggctgatattcaaggctgcctatcatcagcaatggatgaactgggcttgcctagtagatagccttctccaaagtggacctcctgcccctcctcatattaccatggaaattggtgacccaatgggggtatgggatgaggatgttaacaccaagctccatgctgcttccctttgtggccatttgcagcatggtgctaatgaagatgctgtggatgcagaaaaccgtagtccattgcactgggcaggtgtgtgcaggggactcatgggaacagggctgcagagactacagggtgggaaaggggaggcgtgaggagggaagggcagccagggccaaccaatgaaatggtcggaggggatgttgggtcatagtctgagtaggctttcttcatgcttccccttaacccaaacatcttctccccagcctcctctggctgtgcctcaagtgtgctcctgctgtgtgaccacgaagccttcctggacgtgttggataatgtgagtgtcagatgggcaagtgggcagtgtcctacacagaagggctgctgctctctctcagcttgactggccaacttccatgacctagggctgtgttagcaccacccttctcttccttctcctcctgcttctcctcttcttcctcacagagaggttaagccttatcttctggagagcttctaaccctccaaaagggagtgttcagacccaagatctgggcttttattttttttggacaggtgtgaggggaggggagccggtaggattgtcaagcctctgcagtccctggctgctcatgaacctcttcctacaatctgtgcaggatggacgtacacccctgatgatcgcatcgctgggtgggcacgcagctatctgctcacagctgctgcagcgaggcgcccgagttaatgttacagacaagaatgacaagtgagcccccctcgtctatgcaccccaattcccatgcctgaccaatttagaaagaagccagtgggcaacgtgtgtgtgtgtgtgtttgtgtgtgttggggaagaagtcaggttggtctttgtgttcttgggaacctcattccttcccagtggaggttctgaagagctctgcctgctgccaccaccatcttcatagatagatgaccccagaagtagaatcgacacttctggacccgttggctgaatttactggttgtcaaattatcttttatgcaagaggatccttttttccaataaaaaatgtatgtagaatccctgtgatcccagcactttgggaggccaaggcgggtggatcacgaggtcaagagattgagaccatcctagctaaaatggtgaaaccccatctctactaaaaatacaaaaaattggtcgggcatggtggtgggtgcctgtagtcccagctactcgggaggctgaggcaggagaatggcatgaatccgggaggtggaggttgcagtgagccgagattgcaccactgcactccagcctgggcgagagaggagcgagactccgtctcaaaaaaaaaagtatgtagaaccttgatatacagagcagataaaaatggagctcatccagttggccccctaatttctgttcctgcagctctaaggaatggcatttgaaaagcctagtcctggcctggtgcagtggctcacacctgtaatcccagcactttgggaggctgtggagggtggatcacctgaggtcaggagttcaagaccagcctgaccaacatggagaaaccctgtctctactaaaaatacaaaattagccgggtgtggtggtgcatgcctgtaatcccagctactcgggaggttgaggcaggagaatcgcatgaacctgggaggcagaggttgcagtgagccgagatcatgccattgcactccagcctgggcaacaagagtgaaactccgtctcaaaaaaaaaaaaagagaagtctagtctggtctaatgttggtctgttgttctcctgaccccactgaatgagagcttaccctgtgagtggaatgtctggaaccaggacttctgggttccatgtggaaagtctgtgctcagatttgtctcaacccacagatcggctttgatcctggcctgtgagaaaggcagtgccgaggtggctgaactgctcctgagccacggagctgacgcgggggctgtggacagcacagggcatgatgctctgcactatgctctgcacacacaagacaaggcactgtggaggcacctacagcaggccctgagccggcggcggcggggcggtaaaggcccttgtgtaacttccacgttctctaagaatcagagaagtttcttagagtcccatttgtttccatggaagtaatctatctgacaaataattgtcacctgggttgagagtttacgtatttattgctgctactgtgagaggaccccaaatccccatcccaaaagtatgatcacaaaattctttaatgcagcctggtctctcactgaggacagctctggctagtgttgtttctggcgtttgtgagttgtaattgtacatctatttgtgtgatttgttggtcactctctctttcctctaccagattgtaacccccttaggtgacaggccatttctgttttgctcaccattgaagttccagtgcttattaaagtgctggacatagtgaccaataaataaatgagcgaacaaaatgaatgaagtggcccatttctgggataggaaaccaaagttgctggatagttagggatccactaaacaagattggcttctggcaccaggaagatgtgcagtgagattgatcacagagaggccactcctctcagaaaaagtctgaagataagaatgtgggctggaagtacatggaacctgtcttctctctcattttcctcatatcttttcttataggtcagaggctagtccagcacccagatctcgcatcccaggtaagaccctaagtgcctcccccttttgcttttgacacaccccaggctatcccactgtgactattcctagtggtccttggggtgtcaagacatttaagagaagaaaggcactcctagggctcagttcgttgcctagtggccacactttactattctgtttccaacataggcctctccatctgagccccaggcaggttctcctcctaagagctcatggagagcagagcctgaagaggagcaagaggagaaggaggatgaagacccgtgctcggaggagtggaggtggaagtatgaagaggagcggaggaaagttgttcggctggagcaggagctggtgcaaaagacagaagagtgtaagactcaagctgcagcctatctggaccttgagaaccagattcgagagcaggcgcaggagctaggggtcctcctatcctgggagcccagagcttcaggaaagcaaggctctagtctccggcctggaggggatggcatggagcagggttgtcctaaggacctgctggctgagagtacacaagagctaaagaagcagcagcaggcagcagccacagtaaatccagtattagctccaaagaaggctgaggactcagccccaggaaagatccagtatgaagtccatggaaggtcccaaccagaagaacaggggccaccccagagcccagcgtctgagaccatcaggaaagccacaggacagcaactgactaccaatggggcacagacctttggccctgatcatgctgaccagctgcctgctggtcagaaggagagttcccaggttctaggagttgaaccaggaggcacagtggctgaaccagtgggcccagcagccatgaaccagcttctgcttcaactaagggaggagcttgctgcagtgtggcgagaaaaggatgctgcccggggggctttgtcaagaccggtcatggagggagccctggggactccccgtgctgaggcagcagcagctgcctgggagaagatggaagcccgactggagcgggtgctggcaaggctggaatgggcaaaggcaggactacaggtgaaacctgaggttccttcccaggagtccagagagggagccctaaaggcagccccagggagcatcaaacaggatgaagagaaggagaaaagggttcctggggctcgaggagagcctctaggggcccttggaggggaaaaggccctaggaggcctggcaaagggacagctggagaaggagatgtcagtactgagactgagcaacagtaacttgctggaggagttaggggagttggggcgggagcggcagaggttgcagagggagctacagtccctgagccagcggctgcagcgggagtttgtgcccaagccagaggcgcaggtccagctacagcagttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagaggaagtggctgagctaagggcccgggaggcagccagcctacggcaacacgagaaaactcggggttcgctggtggcccaggctcaggcttggggccaggagctaaaggctctgttggaaaagtataatacggcctgccgggaagtgggtcggctgcgggaggcggtggccgaggagcgccgccggagcggggacctggccgctcaggcagccgaacaagagcgccaggccagcgagatgcgggggcgctccgagcagtttgagaaaacggcagagctgctgaaagagaagatggagcatctcattggggcttgccgagacaaggaagccaaggtgagcagctgaggtagccctggggagcactggggaaagtttctgtgtatttgggagtttactaacctgaatccagcaacctttattgcagcagtgggtcagattaataccccaaacggagcaccagtcctttgcagggaccacactactatgttctcgtgggtctgagggggttggtgagattggaggtgaggtaaggtataagtggaagagagaagggggcttaggtactaaaatttggcacccagattcagaagcagtgtgctcagggctgccaccagtgcagcaccatcgtttattagcatttggacttgaattgcatattagcctgggaagaggcctaatagcatgatgggttgctgtggttttactgaagttctgaggaggtcactcaagaactaatgagttaagaaaagtagacccagcgagagctgctcttctcgcctccacttcagggtgggttctacaaaacgatgtccattggcaaagagggcaccaatgcaaagaaaaaaatcttgaggccgggcgcggtggctcacgcctgtaatcccagcactttgggatgccgaggcgggtggatcacctgaggtcaggggtttgagaccagcctgaccaacatggtgaaacccggtctccactaaaaatacaaaaattagctgggcgtggtgcgggcacctgtaatcccagctactcaggaggctgaggcaggagaatcgcctgaaccagagaggcagaggtagcagtgagccaagattgcaccattgcactccagcctgggtgacacagcaagactctgtctcaaaaaaaaaaaaaaaaaaaaaaaaaaaagaaaaaagaaaagaaagaaagaaagaaagaaaaaaagcttgaaaaccactattagataccagagtttcctaatgcttgctctaaatgtgagtctacatgtttctatgagacatgttttatgaactctaaatatcaatttacacatggatttagtacttccagacttaaccgtgaaatgaatgatttcagacttcttattaaaacttggatacatggtcaaatttagaatgattaaaaaatataaaaaggccgggcatggtggcaaaaattagatgggtgtggtggcatgtgcctgtaatcccagctcccaagaggctgaggcaggagaatcactggaacctgggaggtggaggttgcagtgagccaagatcgcaccactgcactccagtctgggcaacagagcgagactcctccttctcctcaaaaaacgttatatatatatatataaaagaatgtatgttttctatagtgtggagtacataaaaatagaaggaatgttatccagaataggaatcagtgcgggttgaggttaattaaagaaagtatttttatgttgcattgaaggagaagttgaaagtagacaatcgggtgaaagcaaacatagtgtcatggttaagaatgtgttctctggaccaagattgtctgatcttgggcaagttatttaacatctctagtcctcagttttcttatctataaaatgaggataataaaatggttgtgaagattgcattaaataagaaattatatttatttaaaagatttggggctgggtgcggtggctcatgcctgtaatcccagcactttgggaggctgaggcaggcagatcacgaggtcaggagatcgagaccatcctggctaacacggtgaaaccccgtctccactaaaaatacaaaaaaattatccgggcgtggtggtgggcgcctgtactcccagctactcggagaggctgaggcaggagaatggtgtgagcccgggacgtggagcttgcagtgagctgagatcgcgccactgcactccagcctgggcgacagagccagattctgcctcaaaaaaaaaaaaaaaaaaaaatttggaactcttggcccatggtaagtactcagtaaaaggtagctatcattattcctactaccactattcctattactgctagttaccattaactgcatttgtgcctctgcctcaataagccataaggactcatctccatttcccttagtggtcagtagccaggagtaggttaggatctgataccaagttaagagcatcggccaaggagtcaaagagattgtggttcaaatcatgatttcatcacttattagctgtgtgattttgacaaattacttaatttagtctctttatctacaaaacgtagattataatacttccctcaggcggagcacagtggcttatgcctgtaatcccagcactttgggaggccaaggtggatggatcgcctgagcccacgagtttgagaccagcctggacaacatggcaaaaccccaactctacaaaaaaatacaaaaattagctgagtatggtggcatgtgcctgttcctgtgctactcaggaggctgaggttggcttgagcccaggatttagaggttgcagtgagctgagatcacatcactgcactccagcctgggtggcaggtgagaccctgcctccaaacacaaaacaggctgggcgcagtggctcacacctgtaatcccagcactttaggaggctgaggtgggcggatcacctgaggtcaggagttcgagaccagcctggccaacgtagtgaaaccccgcctctactaaaaatacaaaaattatctgagtgtggtggcgcatgcctgtaatcccagcttcttgggaggctgaggcaggagaatcacttgaacctggaggcggatgttgcagtgagcagatggtgtcactgcactctagcctgggtgacagagcaagactcagtctaaaaaacaaacaaacaaaaaaaaacaaaaaaacaaacttccttcagagaagtattgttcctcccggaagaaaagctgttttttttttaaatttttttaagttttcaatgttttatcatattggatagcagctttttttttaattggttacaaaacctaagcccatatacaaaattaggaacacatttagatgcctcttttgaaagaacattttagtctttttaaactgagttttaaaaaaataaaaacaatgcaatttttaaacactgttttgaaaacttaaaagtgcagcaatatagttagtttcctttatctacgaaatggggcaattccaattcagaactggtaaggtcacaaattgaatcaaggaaatgcatacaaatgtctgcactacttgatgctaatgttcacttaaatgttagtttgcactttaaaacatgagaggaaataggaatcatcacagtagaggcccacttttaatcataatgtgtgcaaattttaaaaggtaactgacaagtaaggaaagtccagaagaaactaaactggaaggggtatagttcacaatatcaaaaagatttggacttttaagggtttcaccgaagtttgtgaccttaattagcttttacgttgttattcctacttttagtgaacaccacacagaagaaaagctgttttgagtgttaaatgagacaatttgtataaaattggcacatattaaatactcagtaaaaggaagctgaccttgacccttgtgggagaaatgacttggagcctcattggttgcctctttcctcttggcctcagatcaaggagttgttgaagaagctggagcagctttcagaagaggttctagcaattcggggagaaaatgctcgccttgccctgcagctgcaggtatgttttggctgtcagggatggtgctggagaagaaggtcagcagtggaagtgatgtatatgtgggagacattctaggaattactgagggagacattctaggaattacagaggcctggctaggcagtggtccaggatgggccagtgatgggccaacgagcccacctggtactgctgaccacttcattgtgttgctcctcatgcttgggtgactgagggtggacatgtgacttcccattgatgttcattcccaggattcccagaagaaccatgaagagatcatctccacctacaggaatcatctactgaatgctgctcgggtgagcatggtggagttttgagggaggtatagacataaagctgagtatagggtattgcatttagggtccctctctcttctccagggtccctgtacacacttgctgtttctcggaaagctggatccagtgctaggtctctgatctcatttggtagatcaagagaggttgtgcatgaatgtgagaaggagaggtgtttccccctctgtttcaattctctggcctatagtaaggacttttcctgtccccaataccctttctcagtctcctcctggagccacttagtcctaaacaaggaagaagaggtaggtgtcttgctcccttgttaggaataataactacaaagaatggaacgaacacctattgtgtacctggtgctttgcttcatattcatggttgtaatcctcagagcaatcctgaaaagtagacatcattatcttccctgtgaagatagggaaaaagccatggagaagttaaatactataagtgaaggtatatagtaaataaatagccttccactgtaccacagaacctctccctcacctctctctctccattttctgttcttcatctccttttcttcctttcctgacatctacagggttacatggaacatgaagtgtacaatatcctgctgcaaatccttagcatggaagaggagtgaggcagcctcactgtgtgccctcagggatacgagattctctgttgtgagttgtgggttaagggtgatgagggaaggagtttgggagaaagggcttgggaaaggtgtatggaatgaaattagtcccttttgcccccgtggtggctgacaatggggagccttttggggcatagagcatttgaggtgactgagaagacagaacatggagaatcactgggtggagtcaggaatcagtgagcaggtggactaagggggctgacttatgagatggagactgaaaagaggggttgggtctggggtagggagatgccagtgaaagatgagtgatggtaggatagtggtagacagttgttccttagggcaggactctacaaaatccagaatctcttcactttgataccattcattcaaagagcagtcatcccccaaacctccccccaccccaatgcagatagtccccttctccagtccagatagatgagggtcccttttagcatgttgatatgagtgggaggagactgaggatatggaagtgggtgcatttcatctttgaatttcttctttcagggaataagaaaccctggttgacagaggcttcatcaggctgtggtgggcgggggtgttggccactaggcaatggtatgggcagggcttcacctgacattatggacctcagacctgagaacctggaccctggaatcagcatggatgagaccagaggaggtatggatggaaacaagctctatggaaaataaagcatgaggcaggacggggctgagtgtaattttttttttttctaaaggggagtggggaaaggaatatctttcatccctttattcttttctttttttctggaaacaaatattaacagtatgtctttattcttaaaaacatttttttacaagtagattttttttttgaggcagagtcttgctctgtcgcccaggctggagtgcagtggcatgatctcagctcactgcaacctctgcctcctgggctcaagtgattcttgtgcctcagcctcccaagtagctgggattacaggcatgtgccaccatgcccagggatacaagtagattttgttttttattttgcaaatagactttatttttaaagcagttttaggttcacaacaaaattaagcagaaggtacagagattttcatatattctctgcccccatgcaggcactgcctccccaattatcaatatcctcaccagagtggtttatttgttataattgatgaacctacattgacacattattatcattcagagttcatagtatacattagggttcactcttggtgttagagagtctgttggtttggacacatttatattgacatatatccatcattatgttatcttttttttgtttttgtttgtttgtttgtttgttttgaggcagggtcttactctgctgcccaggctggagtgcagtggcatgatcataactcactgcagcctcaacttcctgggctccagtaatcctccaactcagcctcccaagtagctggggctacaggcgagcaccaccacaactggctgatttttctgtatatttaatagagaccaagttttgccatgttgcccaggctggtctcaaactcctgggctcaagcgatccacctgtcccagctccccaaagtgctggggattacaggcatgagccactgtgcctggccatctctatattatcatacacagtggtttcgctgccctaagaatcctctttgctctgtctgctcatctccccatccctgctaacccctggcaaccactgatctttctcccatccccagttgtgcttagttggaattatacagtatgtatccttttcagactggtttctttgagttagtaatatacatttaaatttcctccatgtctttccatggcttgataactcacttatttttagtaccgaataatattccattgtctgaatgtgtcacaatttatttatccattcacctactgaaggacatcttgattgtttccaagctttggcacttttttttttttttttttttttttagcagagtctcactctatcactcaggctggagtgcagtagggcagtctcagctcactgcaaccgccgcctcctgggttcatgcgattctcctgcttcagcctcccgagtagctgggattacaagtgcatgacgccacatccagctaatttttttctatttttagtagagacggggtttcaccatgttggccaagcagtcttgaactcctgacctcaggtgatccacccacctctgcctcccaaagtgctaggattacaggcttgagccaccatgcctggccttggcaattatttaatttgtttttgaatgaaattcacaaatggccctataagtcagcaactttcaaactttttgatccctagtaagaaataaaaaaaattttttttgaggcagagtctcactctgtcacccaggctggagtgcagtggtgtgatctcagctcactgcatcctctgcctcctgggttcaaggtattctcatgcctcagcctcctgagtagctggaattataggcgtgcaccaccatgcgtggctaagttttgtactttttgaagacacagggttttgccatgttggccaggctggtctcaaactcctgtcctcaagtgattctcctccctaagtactgggattacaggtatgagccactgcatctggccaagaaatacattttgtatcttgtgtatacatagctcgaataatactttactatttctcttctattctttgctaatatactccatcaaaatgcatccactaatgggtcaagacccacggtttgaaaaatagccctcagtgaaaatggggtttgacactcttcctttccactttctcgaatctgtcacagctctaatcttttttctctgccttgggactgttgaatccatgatttttttttttttttttaaggggagattgagagacctggattttcttcaggatatactttctaaagtattttatcaagtgttaaacaatgtgtctatatttgacacacatggtctcactgttctttgtcccaggtgacaaaagggatgaaaagtctgattcctgggtagaggatgaagggatacccaagtttcatttttgcctgtgattccattctcagactgaaaaaaaaaatgtatctctcttggccacttcccctgggtctcctcctctgcctgcccttccaccaggcatgctgttaggtgaaaatgaggcagtgaattcctctaaaatctggaattgcagtttggtggcccgcacgctgatccctccccattccttctctcagtccaccctctgcttggttacactgggtcagacagcagcagttttggcagtaaagaggctgggttgagaaaaaagagtggggaggggctgccatggaagacagggggctacacaagggctgcagaggccagctccagagtttggccaagagtgaaaaagagcatctgagatatctggatcagatcctagagaaggtgcagaggttttacgtggatgggcacgggactgctttacggccaggaaaatggaaaaaggagggattgatggagaaagggggaagaggtgcagctattgaagaaagatcatcaaaagggtctgagtcatttctattaaggggaacagaacctctccttgccttcctgctctcaattaccaatgtatattaaaggactattacatttcttgttatatatgacgtgtggggtggggagaatgaagaaactgtagagagaagggtccagaaagggggagatcattgggctaaactcaagaatgagtcaggaagcagctttggtaatggaagccaggactttggctccctccggggctcctggaaactgattccaggatgggctgagctatgggagtggtgagtgatgttaatgttaacacaggagtagaaacttccttagcccctggttttcccagtctccctccctaaaactccacaaacttacctcaacagccccagtcttaaaatttttcttgagttcataaatttttttccccaaagtagctataatcctaatgttccctttattcctcctgggctctctaatgggacttagcagggacttatgattcctgcttcatctccccaccccattccccaggcttgagatgtaggagtatgtgggtgaaagtaggtgaaacccgatgggccatgatcaggttcagaccatgtttttgaatgccttcaatctggaactttgcttctgattcacagtttccctcctttggtaacattaatttattaaacagatatttaaggagtctactatttgtcaggcactgggaatagagtagaggcagcacagaaaaccttcttatccttttggagcttgcatgcaggataagattcaggttccccggttccgtcatcctgtagggatgctagaacttataacctcaaattaacttttttccaatttattttttctctctttcaataactttagtaacctcaaattaattttttttagatgtattattgctctgtcacccaggctggagtgcagtggtgtgatctcagctcactgtaacctctgcctccctggttcgagtgattctcccacctcagcctcccaagtagctgggactacaggcatgcgccaccacacctggctaagttttgtatttttagtagagatggggtttcactatgttggccaggctggtcttgaactcctgacctcaagtgatctgcctgcctcggcctcccaaaatgttgggattacaggcgtgagccaccatgcctggccttcaaattaacttttttcgtttgtttgtttgttttttgagacggagtcttgctctgtcgccaggctggagtgcagtggcacgatctcagctcactgcaacctcagcctcccgggttcaagcaattcccctgcctcagactcccaagtagctgggattacaggcacacgccaccacgcccggcgaattttttgtattttagtagagacggggtttcactgtgttggccaaaatggtctcgatctcccaacctcatgatccgcccacctcggcctcccaaagtgctgggattacaggcgtgagccaccgtacctggcccaaattaacttttaaaggagattcttccttcatgaaatcactagaactcaaggtgaggttttctcttaaatgtttacagctttatttatttatttatttatttatctagagatggagtcttggtctgtgccaggctggagtgcagtggtgcagtctcggctcactgcaacctctgcctcctgggttcaagcagttctcctgcctcatcctcctgagtagctgaaattacaggcgtgcgctgccacgcctggctaacttttttgtatttttagtagagacagcgtttctccatgttgaccaggctagtctcgaactcccgacctcaggtgatccgcccacttcagcctcccaaagtgctgggattacaggcgtgagccaccgtgcccagcatttacagctttacttattttttattttattttattttatttttttgagacagagtctctgtcgcccaggctggagtgcagtggcgcgatctcggctcactgcaagctccgcctcccgggttcacgccattctcctgcctcaacctctccgagtagctgggactacaggcgcccgccaccacgcccggctaattttttgtatttttagtagagacagggttttaccgtggtctcgatctcctgacctcgtgatccgcccgcctcggcctcccaaagtgctgggattacaagcgtgagccaccgcgcccggccatttacagctttattgacgtacaactgatatacgtcaatatgtctctccatgtaaaatgcatgtatttgaagtatacaatttgatgtgttttcatatgcatatacacccataaaaccattacacaatcgagataatgaacatatccatcacttccgaaagatccccgctttgtctctttttaataatcctccctaccttcctcatcctgcaactactgaaaattcttagaaatacaaactatagtaacttttgatctagaggactgaacagaacaacagcaaaaaagatctcaggacctgatgaagactcaggtgttggaagggagcagctggaatttagaactagttgagtctgagtttagcttgaagcgctcaccaatttgggtagcaaagcagcaaggaaagaacctgagtgttaggagagggtggcatcttccctagggacaaaaaccacaaagtaactgggcctagttccagttcaactggcaccttcaatctttggcctgggtagggtcttatgaggaggattatactgaaggcttaagctaaataaaaggatttttcctatttattaaagcccttttttggtgtgctgattataggtttaacatgtcttgtctctgctgctagactgtgaactcctgcaaggcttttatgtcctcagcacctaatgatccctgataagcactcaaatatttattgaacaaatatgcagccaactataaaatgctgtgagtttctcagtatgtagtgcgggtacatttcccttaagttggtattttctgggtcaggcgcggcggctcacgcctgtaatcccagcactttgggaggccaaggtgaggcgggcgcatcacgaggtcaggagtttgagaccagcctggccaatatggtgaaaccctgtctccactaaaaatacaaaattagccgggcgtggtgacgcaggcctgtaatctcagctattcgggaggctgaggtaggagaattgcttgaacccggggggcggaggttgcagtgagccaagtcgcgccactgcactccagcctgggtgacagagtgagacttggtccccccccaaaaaaataaaaaaataggtatttccatggatacagaaacagatttaatttggtgcctgcatgtgagtgatcagcttggttgggatggggcctctggagggtccaaggctttggaggaaggagagtgggtaggcagttcagagagggacagaaagatcccttttgtgggtaagaaaacccctctgttcatcttcagctacaccaaaggtatgggggctctggtggaggtattctgcacgtgtatctagggtagttactgttaggtacactttggattcagtaccccaggctttgccctagggagggacagttgtcatttcaaggaagactgctttatactgtcagatacctggttcacaccggcttagcagcagtgtgccaccaccccaatcccatacgtaagcgttgaggggtcacagaggtagtgagaatgatgggatccaaggatctcgtctctccagatccactcacaccaggagttaatctctccaacgtcgagctctgagtccctccctctctcgcccgagctccgccccccttccctcttggcggtcctggcgggcttcccctggagggggcggccccagcccgagcgctaggcggggcggagctccggcccgggcggagccgcggccgccgcgtccggctgctggaccgaacttctgccgtgcggacagcaggagcagcgccgagccccattcccccacctctccagctcgccctctgagcctcccgagccctctctccatttcccacaattgtgctggtaagtcccgctccccgcaccaaacttttttttgctgccgagtttgagtcctacgatcggaccacgagctgcactgtagttggtgtatgggggaggaggagagggtgaattactgaatgccgactccacggcttccctaagacggatcagcgctcgcccatttcccgagttggaagacctctcgattttagttgattaaacttatgcagagatggagatgagggtttgcgctccaacttcgctaccccctcccccatttctctgagctctagcagttcccgatactttccctccatctttcaagtatctttggctccctaaaagcttgtcccctcccaactctgccgtggcaaagcccccctccaccaggcacttcgggcccgcctcctccccgttgccctagggaccccgcgatcttgggggccatacactccctccggggctacgcgtcctgccaaccggccgcagacgtgtagctgctgggtcggctgtggagggaggggctcaggctggggcttgtccgaagccaggcgggcggggccgggaaggggaggtatagggggccggactgggcggagcaggcggcatttgcggccggcgccagggtggagagttgtgcgccggtccctgggcctgagctccggctccggctggggcgcctgcgatgtctcaagatggcggagctgggcgaattaaaggtaccggccccctccccccatccccatctggactcagcccggcggtacgccgtgtccgggaagcgaccgagactgggtgccggggctcgggtgggcgccgacgacgtggcaggcacgagctgctgaggatgggagagaagtagctgagagcgaggaaggggctgcggcggggctccgggggcggggctgcggggcagatgtaggggtggggccgaggggaattgcagctgttgggggctgaggcgcagggggcggggacgaggggtagaagtcggatttagtagtaggggcggttgttggggtagggccagggggaaaaggtgctgtagaggcactgggggcgagtcgatcaaggccaagagatgcaacagtagggggcacatgcagggatgggaccgcggggcagacgtaggggaggctccgggggaaaggcagctgagaggatagggtctttggggtactctcgggatccgagctttgggaaataccagtaggctgctgagatgcagggggcggggctgtgcgggccgatacctcgaggggtggggcagaagcatcctggaggctcagaggaaggtcctgccgtagtgaatcgcggtgtttgggaagaggcagaggcatgtgaaactatgggatagaaaggtgggaagttataggggaagctaatggagaaaaaaagacaggacagaggagataaggatggggagaaagaggagcaagtttctcatcacattccataaaaggggtccaagacaaagcctcctatgagaagaattgtgtagggctagcaagccctgcacatgacaggatctcctagagattcacagaagggagtcttctaaggagagcgctcccctcctgctacatagagtttggagggtgaccacatctgaggacatctcatagaacctcaaactaccgagttcatccgcctgcctcctggttttcttctgccctttgaaatgggagctatggtcctgggaaggctggaggtctagccactgggcccagctaccttcaggggatttgcgattctgtgccctgactcagaggcttttccttcatccacccagggtctctgtttagagctctgccctctcctcttccacccctataggggggcgctgtaagttgtagaggagtattaatttctctgtgtaggagagatgccagattatggttcctggcagatagagtaaacaggcaggatacttggactcagtgattcactgttaatctccccgacccaagttttggtcctgtttcccttccagaaaaataggactaagttgtggggagggggtggttatataaacgattccaagaaaggatctggggaagttatgagcattgaaccctgacctgaaaaccctggccacagaagcttcagaggcttgggggaaatagctgaggtgaattaaggtggttgggaggggtgggctgaagggcacaatcctccagccacctagcccctttcttcccctggggctgtctggcttgaatcctcttgtctctccctccttctccctgtctcctatcctgttcccaggaggctgggatgggtttgagagtctgagaaagggcaagagaggagataagcagcttaaagcagagtccagggatggaggcgggaggctgcatggactcggaggtgtgtctgagggtggcttgctgtctgccattccctgccccactctggctgcttccaggcctggggaaatagtgttgctcaagctcgggggtggtggtgatgatgctgacctgatggttgctaaagtgggactgagatgtccctttggataggtcgactacctggcagtaatccactagctgcgaagcatcatctttcccatcagtgctggagagaaaggcactgcccacctggtagctcagcccatgtcttggcagggcaggcctgtgcaagggaggatgctcaagcttctctgtttttctccacagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttggtatggctctttgtggtcccttagtcttctggactccctacctgttccccaaacatttcttaggctttagtcctatgggatcagtgacctgggatgggggcgatttctgtggctgcctgtgcatgggcttggaataactgcccctttgtatcctcagcatccacttctagccagcggtttgaggaagcgcactttacctttgccctcacaccccagcaagtgcagcagattcttacatccaggtacatctcttccagtcttcctgcctcatccctggtctctgctttctgactttcttctcttctgccctgtgctcttccctatccctcctcctatacctacttgtctcttgttcttctgtgtgtctcttctctatctcctggacatctgactttcagcctttctgtgcattcacccttgccctctgggggctacatgctgacatctcttcatctccctccctgttacagagaggttctgccaggagccaaatgtgattataccatacaggtgcagctaaggtgagttcatcctccctgcctatcctgggtacccactgggggtaggagtgaagtaggggtatgacagatacccttacgagatgtccctgctctgccactgcctactgcagccctgcgactcttgttggatgctgagggcttcaggcatctatgactgattttctggggttccctgtctctctgccagattcaagttaagaaatttcttcccactctttcttcctttctcatctcttaccaggttctgtctctgtgagaccagctgcccccaggaagattattttccccccaacctctttgtcaaggtcaatgggaaactgtgccccctgccggtaaatgctctccccttcttctgtcagtaatcccttaccgtttcagttcataaatattaactacaaacctattctgaaagagacatgcctagcacagtgcgtggcacatagtaggtgctcagtttactgactgaatcaatagaatctcgagagtattaagatagggctgaacaaaggttttgtgagaactcggaggaggacattagttcaacccgagatgtaagaaagacttcttttttgttttttttttttgagacagagtcactcgctctgtcactcaggctggagtgcaatggtgcaatctctgctcactgcaacctctgcctccctagttcaagcaattctcttgcctcagcctcccaagtagctgggattacaggtgcccaccaccctgcccggctaatttttgtatttttagtagagacggagttttaccatgttagctaggctggtctcgaactcctgacctcaggtgatccacccacctcggcttcctaaagtgctgggattacaggcatgagccagtacacccggccagaaagacttgaccccagagctgagagttagaaaaggtgaggcatccttattcctcctcctcagggactcagtgagttccttttttctcagtcaataaataagctctcctttctccccaggagtgaaccccacacataaccctagacagtgctccagttttgtgagccactgaatgggcctccatccccttggtcagtgagtgagcgagttggccttccctccagggattgaataacccgagacaagatatcttttgttcaaagagcagagccccttcccagagccacttctccactgaccaatccctcccttctccagggttaccttcccccaaccaagaatggggccgagcccaagaggcccagccgccccatcaacatcacacccctggctcgactctcagccactgttcccaacaccattgtggtcaattggtcatctgagttcggacgggtgagcacagctaaagcaggtgcctggaaaagcctgctgagggtgaaggggaaccatccagtgtcctgggttggggaagcattttcctctttatgagtctgtctctggtcctcatggaacaaaagtgggcagtggtggtatgagaagcagaggctaattgtctaccccctgcctccaagtagaattactccttgtctgtgtacctggtgaggcagttgactgcaggaacccttctacaaaaactcagagcaaagggtatccggaacccagaccactcgcgggcactgagtgagtaacatctttcctctcttccccacctgatctggattcaagtcttcctggccctccagccttcataattaaacccatacctcttttttgacaacttactccccttctcacatgaaccccaaccctccccctctacccctgaccagtcttccagtctttatagttgaagttggaccactcccaggcacccttgaatttccaatcatgtatctgctttgcacctcacagtccctaactccagccctgctagaatatgggctctccggactggaaagaatcttaggggtcctctaatctaaccctcacatgatgcttcaactcctccagatcatctctaacatagccagagtgtcacgctatgtttaagcatcttcagggatgggaaaatcccccacacccagccttcatcatccatatcccagaccacttccatgtgacgtcccactggcccccaaagacgctccacccagcagcctctcagccagagccatctgttcctggccttaccaactcctgggcttcctccagccttgctgaccccatggctctggcctcacttttgtttcagtcaaggagaaattgactgctgaccctgacagtgaggtggccactacaagtctccgggtgtcactcatgtgcccggtgggtaaaaggggagaagggaacagggtgggaagggagttgggtttagcctgtggactttgatgagggttcctagggatactggcgtgaagttttctgggatgaaatcagagtagggcctctgacaagagaacttgcttctcctcagctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatgggtagggccattttgcttcctcttacctaggacatccactagaacctcttttcttggttatttctttttctttttcttttcttttttttttttttgagatggaatcttactctgttccccaggctggagtgcagtggcacaatcttggctcactgcaacctccacctcccgggttcaggcgatactcctgcctcagcctcctgagtagctgggattacaggcacccaccaccatgcctggctaatttttgtatttttagtaaagactgggtttcaccatgttggccaggctggtcttgaactcctgacctcaggtgatctgcccacttcagcctcctaaagtgctgggattacaggcatgagacaacatgcccagcctataatatttcttttttcttttagccaccacctccttcagggtttttaattcatatggcttacttcccctcacatgaactgcaattctcaccttatctatcccttttaccagtctgtgtgtgtgtgtgtgtatgtgcatgtgtgtggagggggagggcaacattaaggacttagtatatacaaggcatcttgctgagcactttgcatgagttatctcattgaatcctcacaataaccctatggactcggctcctacctgtaattccaacactggaaggctgagatgggaagatcatttgaggctaggagtttgagaccagcctgggcaacatagtagaccctctctctataaaaaattaaaaaaattagccaggcatgttataatagctcatgactgtagtcttagctgctcaggaggctgaggcaggaggatggcttgaacccaggagtttgaggctgcagtgagctatgattgcattactgcaccccagcctgggcaacagattgagaccctgtctcaaaaaaagaaataatcctatgattggctagtgacactcacccagaaaaaaaaaaagaaaaaaaaaaaccctatgagataggtagtatcattacacatgaggaaactgaggccgagagagattgagccttgctcaaggttatattgttaagtggcagagccagtgtactgaactgtcataatatatcacctataacaactacctgacttcccactgagcattgcaataaggttcttttcagggcctggatgttctaatcttttgatcttgctagtcttaacctctttttggaatctacattatggttcctgttcccagtgctcccccactttttgtttgtttgtttgtttttgagacagggtctcgttctgttgcccagactggagtatagtagcacaatcatagctcactgcagcctcgacctcctggcctcaagtgatcctcccaccttggcctcccaaagtgctaggattgcaggcatgagctaccatgcctggcccctagtgcctttatttatttatttttacacaagtgtttagaaagccaaagacccagtgccttttggagatggtttatggacttctgtgtctctgctccttttgttccttatactacacgtaagtgctcagattttttttttttttttttttgagacggtgtttcactctgtcacccaggctggagtggtatggcacagtctcgtgatctcagctcatgcaacctctgcctcctgggttcaagcaattctcctgcctcagcctcctgagtagctgggattacaggcatgtgccgccacatccggctaattttgtatttttggtagagatggggtttcaccatgttggccaggctggtctcgaactcctgacctcaggtgatccacccacctcagtctctgaaagtgtgattataggcgtgagccaccacgccggctttttttttttttttttttttgaggcagagccttgctctgtttcccagggtggagaacagtggtgtggtctaggctcactgcaacctctgcctcctgggttcaagcgattctcgtgcctcagcctcctaagtagctgggattataggcatgtgccaccacacctggctaatttttgtatttttagtagagatgaggtttcaccatgttggccaggctggtcttgaactcccagcctcaagtgattcacctgcctgtacctcccaaagtgctgggattaaaggcgtgagccactgcacccagcctcagattgtatttattttaaaacctattacttactttgcaaagctcttttacataccttgtgttatttgattccaacaactcagagcggtccagtaggatggataatgttcttattttacagatgaggaaactgagatacaggaaggtgagttacagaactctggctactgttctgctcatctcccagccccgtgaattttcatctctctcttcccccagtttatttatggagattcttagttcctgttcagattgtgatgagatccaattcatggaagatggatcctggtgcccaatgaaacccaagaaggaggcatctgaggtttgccccccgccagggtatgggctggatggtgagtgaccccctgttccccagctaagctaaatcttggatggcctcttctctgagacgtagtcttcttaatacccacaggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaagggtatgagaaaataggctgagtctacagcaaaacggacaggggaagaagtcaggattgctttctgatcattggacaaagcctggggcaagagaaatgtggaggggacagagagggaacctggggacctgagctgggtgagggcatctgtggtttgctggctgcctcagctcctctctacccacagagtcctgacatctggccaccagccatcctcggtgctaaggagccctgctatgggcacgttgggtggggatttcctgtccagtctcccactacatgagtacccacctgccttcccactgggagccgacatccaaggtatgacatgggtcataagatggaccctgcactgccacaccctccccagagctacatcagaacccctgttccttctcaaagcctcctgcttctcctgcaaggggccacagtccacagtgctttgtcttttggtggtaaaggggtcagataggaggttaattttgatttttcttttcctgccaggtttagatttattttcatttcttcagacagagagtcaggtaagtggttctttcttcagaaggtctcagatctctgaagcttcctttctagacactgatggggcccctccctctcttatgatctctggggatgtaaatctgctttcccgtgagggcagtggggtgtaggtatcttattatctcctcagccccactggtagttcctgagattcctacttaggcctccttcctagatcccctgttacttttctgccctggcctactcacccctacccccgtgtgcacttagagcaccatgcctgctctaaccggacattccacacatttcagacgcccacaaagccaagaacctaacaagttggaggagctctctcaaggcagggaaaggggaagggtgtagggaagtaggggaaagagggagaggctctcctgcttctcaagagaataccttcggatccacaggggttgattgctctcatacggcatttctgagatgagtgactgggaggtggggaagtcaggattgagatcttaaactatgcccttgattcttcctagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctccatttatatatctaagttcacagtgtttcttattcccccctaagcttctagaggctcatggccctgtagttaggcctggctcattctgcaccttgccagggaggtggaaggaccctgtgccctccttcccaatcttctttttcaggctcgccaaggcctaggacctatgttgtaattttactttttatttctaaagttgtagtgaagctctcacccataataaaggttgtgaatgttctgtgagtgtcatggagatgggctagggaggggattttacacttcactttccagacccctggtttgggggaagagggtccatgttccattcttcctttgctggccctgggtccaggtaagctgcacttttacacggtgggggtgttctgtggaggaattccaagagaggttgtcctttcctgctttcccccgtgcctgtaaaaactagaccattccagcccagtactgtggagctctccagtcctttttcacttttacctgcccagatgttgcagccagagcttgagggcaaacttggttccagtgctgactctctctttgtcctctgccatggttgggatcatccgcaggagggtggacatgtgcaggaccagaggtcgggctcttccatcctcctctagttccactgcactgcatggtgacaactcctgttggggctgtgccttgtagcttacaaagaacttacatatatgttaggtccccgaatcctcccaactaccacaggaggtgggtgggtgttgacctcatttgcagaaaggaaacaggttcaaggagggttaaatgacttgcccctgtgttagaactgacacttagaccttcaatgctagccagttagagcaagaatctttggggtttgatggtcagtgtcttagatttcatgtaccttcttaattatcagctgacccactctccttaaatctcccccacaacacaaaattccatcctgaggacaggatagacgctgaacttctcaacatgaatatgttggtgtattagaggctgagggagaagctcttacttacaggacagagggtggtaggtcctgggggagaagtccgggtgtctctgtcccatcctctgcggcagccactgcagcagctacatctggtgtcagccacataagggcgctcacctcatttgggtttggttggatccgggcctggggtcagacatggtgacccctcagtcattgcctctccctgggctgcctgttcgtgatcaaaacctacccgcaggtttcatggagaaaggcaggagcaaggggaaagggcattgcatattcttcgttatctctgactacccccgccacccccgcccagctcctaatcacagtcagaaccaggttgcttgggctcccctgagccctgtttccttccctcactgccagccctacctgcaactgctgctgtgattcctgggagatcacgagtagatacagaacaatgtgatggtatttgggtaaaccccagctcagcctaggagggtaggcagactaggaaaagaaaacagcaaaagtgagaactttccgtcactttttttttttttttaagatggagtttcgctcttgtcgcccaggctggcatgcaatggcgtgatcttggctcactgcaacctctgcctcctgggttcaagcaattctccagcctcagcctccagagtagctgggattacaggcgcctgccgccacgcccagctaaaatttttgtatttttagtagagacggggtttcgccatgttgtccaggctggtctcaaacttctgacctcaggtgatccgcccacctcagcctcccaaagtgttgggattacaggcgtgagccaccgcacccggccctttgtgtcactttttgagactttgttaatacagctttagggtgaaacaaaatggtggccaaaagctgagggcgtggatggtacagatgacacagcagggacatgggtgagggttatggatttggggattccagcccacttatgtgctattgtttcccttgtagccaaggcaggtaggggctgatctatggaggagcttctcccagctacttgtctcacctcccataaacccagagggacccaagagaactggccctggggcaggtgtagtccactctcctcccaaagttctcgaagccctccgtccagcagctgggagtcagagaagacacatcagaggggccagtgcctgactcttccaagtccttttgcttgcccctccctcagcccacacccaagatggtcccaggcatgggtctcttggctcaggttggatcagctgactggttacctcctcctcaagttccacgtgcccacctgcaacaacagtggggccagtaggtgaatggtggtggtcttggccagggagcccccactcactgttgacactcctctcccctccagtggacacagagggagttgcagtcccttgtgactatgaacatgccacattttggggcccactttatccttctgagactgggaaaaacattgttgcggggaaagggcaaatttcttctctgtacttggggccttgtccccagaatactcacccgggggtacccagaggttgggggaaacgctcagggtgcgtgcccttcgggttagcaagacagtcttgtcgctggactgcagaatgacggccacacccaggtccacacctcgatctgtgggcagctcagccccagggaccctgggccgctcctccagggccgcaaaagggcagaaagggggtcgctggcagaaggaagccagctgggttaaggcttcagaagggcggcactgggtgggcgtgacttccaaaaatggggctacaccgcgcgttgggggcggggtcctcgccgccagttcccacccgatttcagtccccatctttggcccttcactgcccccgctctggggcccccttctgccgacctggagcggaagcctagcggaggcgcctgggaagggcctgctcgagaggacaagccgtcctcgcttcaagctgcagtgaatgggccacgtcccgagccctggtccggctcccaggaggccacacacactccgtgcgaagctcaccgactccggacgccgggacaggagcagctgcacccgcacctcggccataacgcgactctggagtcgctgcggcccgcctggcgccctctggtggcctagagaagcttccccacggaacgttccgcggggtcgtagcggggtttccgaaagtccccggggaaataagggcacatcttttgaggatgacccatgggtataatattaaaccacaaagaagaatacctctaaatgctcagctcctattccttcctatcttctctgtttaggacaatgacccccagaccgactgacttcaggacccacatgttacttccaaccagccctaagctgaactgtaagcatcctctacagcactatgcacacctgttacagcaggcatcacttcgaattaattatctccaagcgaaacacaccaaataacattttcgataccacttctcctttcacttcactcaaatggcaaccaagtatgcagatgctatctccttaaacttcctcaaacccatgttctctccagccttcattcattgccctagtttaagccttcctcgtattttgcctgaaatattattgcaagtctccaaatagtcttgaccctaccagttcattctctacagtgctgccagagtgatgttttgttttgagagtctcactctacagcccagacaggagtgcactggtgtgatcccagctcactgcaacctccatctcccaggttgaagcgattctcgtgctttagcttccgaagtagtagctgggattacagggcgcccaccaccacgcgcggcctttttttttttttgagacggagtctcgctctgtcacccaggctggagtgcagtggcgccatctcagctcactgcaacctccacctccctggttcaagcgcttctcccgtctcagcctcctgagtagctgtgattacagatgtgcactacccacacctggctaatttttaaatttttttgtaacgatgaaatctcactgttgcccaggctgttcttgaactcctggcttcaactgatcctcccagtgtgttgggattacaggatttaggcaccatcaaaattatcttctagctgttttgaaatgtacagtaaattaataactatgccaccctgatctatccaacaccagtcttacttcttcaaactgtattatctgtgcccactaatcaacctctcttcatcctccccatccttcctagcctctggtaactaccaatctattctttattttcttgagatccacttttttagctcctatgtgagacagaacatgcaatatttgtttctgtgcttggtttattttacttaacataatgacctccaattccatccatgttgctgccaatgacaggatttcattcattcttatggctgaataatacattttctttagcctttcatctattgatgggcacttaggttgattccatgttttggctatcgtgaatactgctgcaataaacatgggagtgcaggtatctttttgatacattgatttctttccttttggagatatatatatacccagtagtggaactgctggagcatagttctgtttttagttttttgaggaacctctgtagtcttccacagtggctgtaccaatttacattcccaacagtgtaccaggcagggctctcctttttccacatcctcactagcattcattctttcttcttgataaaagtaatgaattggggtgagatgttatctcattgattttgatttccatttctctgattagtgatgttgaacattttttgatgtatctgtcggccatttgtgtatcttctttcgaaaactacctattaagatcttttggccatttttaagttggattgttctttttgctattgtttgagctccttatatattctggttacgaatcccttgttaagatagtttgcaaataaagcatcctcatctttcaaactatacattgtcactctctgtgttcccttccctgcctgacccttttccctttctggcctctctgtacatagtgtttactcttctactgtagcacccctaatacttcctggtacttatgtacttatttgtctcctcctactagactgtatgctcaaaatttattaatctttatatccccaaggcttaccccagtacttagcacaaaacaggtgcttagtaaatgatggtgactggcttgagggcagagatggtgtcttatttatctatccttgtatgttgtgtttagtatggtggctggcaattgtttgacactcaagtgtttaaacaattagaaaacacattggtgagagaaaactgaagatattataaaacaacatctaactgctttaaatgaattaaagctgctgggacaaattatatccgtgatactgagagagagaatttagcgttgccagttttaaggaaccatggagaagaggaaggcgctaatttactgtgtgcttaccatatgccaggcattgagctagctgttctacatacacagtttcagatgtgttagaagcctggagctggcaaatgtggcttcagtccacagattctagtgtgactgcttgggacaatccacctgctaaccctgaaaataattttttcttctactctgtgatagtctttcacattccctacactgtgtgtgttaaaaattacagttcatcagcctgggcaacacagggaggccctgtctctacaaaaaaaaaaataaataaataaaaaatagctgggtatgtgtggtgcatgcctgtagtcccagctactccagaggctgaggtggaaggactgcttgagctcaggaggtcaaggctgtagggagctgtgattgcgctattacaccccagcctgagtgacagagtgagatcctgtctcaacaacaacaaattatctatcatctatctatctatctatctatctatctatctatctatctatctatctatctatcacctatctcaacaaaataaagaacaggcatagacatctgaaaataaaattaacttcttaggaagtttcctattgccagggatataggtaaccataggtgtgggtaacttctttatgggaacagatgcatctgatagatgattaaccttgttgatttaaggttcttcccactgccaagatttgatgaggggagactacagcaatggatctaaatatgccaaattctttcaggtgtatcctgggctgcaggggatagagaggggggtttagttgaagactctgcgacttatcccactgcaaataatgcatccaggcacctcctttattttgctttccatccccccagatcttctgaggaagatgcttcttctggatcactgtctcttcatggtgcactcaatgtaagactccagcaggaagatggtttcgtccacctggatctcactggcatccaacctgagtgaaaagtaaaggcatttgcctagactgaatgttcattagcatatttaagattagaggttagggtgggtgtggccatggataactgcttggttacccttgagagtggatggaaagaaagcaggagaaccagtagatcattttgctatttaccgagcatctttatgtgccagacaccatgcaaactgctaagaatacaaaatacagagcctctgtcctgggggaaggtagtcttcatttgcaatcaggaaaacgaacgtaaaggcacaggtataaaaggacctagtgtgttttaaaatagcaagaaactaagagtgtctgaagcttaaagtgagtggtgattaggaagaaatggaagcttcttcagcctgacaaaagccatctaggaaaaacccacagctaacatcatacttaatggtgaaagactaaaagcttttctcctaagatcagaaacaaaacaaagatgtctgcttttgtacttctattcaaccttttactggaggttctagccagggtaatggggcaggaaaaaaaaaaagtaaaggcatctagattgaaaagacagaagtaaaactctctctattcatggatgacataatcctattataaaaaatctcaaagaatctgcaaaaaaactactagaattaataaatgaatttagtaaagttgtgggatacaaaatcacaacacaaaagttggttgtttttgtataacactagcaatgaacaatctaaaactgaaataagcgaccactaaactagtatccaaaaaaatacttaagaaataaatttaatgaaagaggtgcacaaattgtgcactgaaatgtgaaggtctaggaaagaggtgatgaaggcctgcgtgtggaccaagatgaaaggccagatttgagacacatgactcaagtaaaattaagccagcgcagtggcacttgcctgtagtcccagctacttgggaggctgaggcaggaagactgtttgaacctacgagttcaaggccagtctgggcaacacagccaaaaccccgtctcttaaaaaaaatttatcagtacttgatgaacaagagagtgtatatggtgatggagaagaagctcagaacatcttcagaattgctagtttacaaaaataggtggattaaattctgttaagtgagctggaggagacagtgagtttaggtttgctcatgctaagctggagggttacaggaggtcaaaatggattttctggatggtattctgaaatgcaggtctgaagtttatgatgcttacttgttgacattacgtttcagggtctctagctgctgacgttcaggagctgtgatcatctcctctatttcttgtaactgtgcttcctctgcaccagtagcctgcatagatgcaatgatggcttctaccctctgagatttttctagtagacgcctgtcaaacaaacacaactctgagacatcttccctaacctgggagattctcttaccacgtgtgtctgaggcactacccaccaccctttaccattttcctgatcaaagtagataatgtcaccttctaaggacattttctacaaacttatttggaaatataacttcactcctgaaattcttattgcctctcatttgcacttaaaagtttggtgcttttgtacgtttctcacaaatttaatctgaaaaattatttcactgggagcatgttagaaaagtgtagactaatgcatgatttacactaatctaagccaatgattcaatgcaagtagactggttgctatctctactggttcctacttctcaaaaaaaaaatttttttttttgagatggagtctcactttgtcgcccaggctggagtgcagtggcgtgatcttggttcactgcaacctccactcactgggtttaagtgattctcctgccttagcctcccgagtagctgggactataggtgcccgccaccatgcccagctaatttttgtatttttagtgaagacagggtttcaccatgttggccaggttggtctcaaactcctgacctcaagtgatccacccgcctcagcctcccgaagtgctgggattacaggcatgagccaccctgccaggcccagcgtctattgattcctatttctagaggaaatttcccctgaggcccttgatcttgaaagatgtaaataactcaactgaaaatgttacttacttattctctttggtttcaaattgcctcctttctatcaagttggctatgctctgaggaaagagaagacagacaaggaatgcacatagttctatttcagcagctcagggcgaagtgggcacatgaggggtacttgaccgtatggaggaaatggggagaaggtccagattgagttaccttgtagcacctgtgcaacaacattcgggcagctgacaggatgttcacagtatataaatagaaggtcctggatggggcatggtctggtgttttgggaatttcctatttgtccaatagaaagaaaaatagcagaaattatactgttttagaactggcaaagcacacactcattctacctggagttacttagccctcctttttacttacactttcctgtttcctagtcattcagtacctgtgtttattttatttatttattttgagactgggtcttgctctgttacctaggatggagtgcggtggcgtgatatcagctcactgcaacttccacctccggctcaagcaatcctcccacctcagtcccccaagtagccggaactacaggcatgcaccaccatgctccgctaattttttaatcttttgggggtggtggagacatggtctcactatattttccaggctggtcttgaattcctgggctcaagtgatcatcccgccttggtttcccaaagtgctgagaatacaggtgtgcccggcccagtctttgtggtttatgtcataatcagtcaaatggagagctgggcttccctgttttttccatttgactgtcagcatcctgagctggggaagaaagggagggcaactaacatttactgaacaactctatgtgccaggtaaattctatttgatctttacaaaaaatcgtattattattatttttgagacagagtcttgctctgttgcccaggctggagtgcagtggcacaatgttggctcactgcaacctctgcctcccacgttcaagcaattctccttcctcagcctcctgagtagctgggattacagacacacggcaccacgcccagctaatttttgtatttttagtagagacagggtttcaccaggttggccaggctattctcgaattcctgacctcaagtgatccgtccgcctaggcctcccaaagtgctgggattacaggcatgagccaccgcacctggcaaccatattatttttattatcaccatccatcactgttttatagatgggaaacgtggtaacttgcttaatgtaactgggtaaggcagagctgtaatctgactccaaaaatccattctatctatttactcatatgctctactaaatagccctgcaaagactcagttagatgtgttgataaatttaaactataacagaattaaggcttaaggaaggacagaaatgagaagagaaaaaaaggcagggtgggtttggggtgatgtcctggctctgcctcttttttgttttttgttttttttgttttttgagacagagtctcactctgttgctcaggctagagtgcagtggcttgatctcggctcactgcaacctccccctcctgggttcaagagagtctccttcctgcctcagcctcccgagcagctgggactataggcgtgtgccaccaggcccagctaattgttttgtattttattagagacggagtttcaccatgttggccaggctggtctcgaactcctgacctcaagtgatttgcccaccttggcctcccaaagtgctgggactacaggcgcgaaccaccgtgcccggccacctctttctcactagggcagttaaggccccaaattatcctccaagtgctcgctatgtctctgtgaatcatgtttttctgtctcagagctggatatagagtttgcttgggggttcagtatgtttgcctaagaagcttctctcaccctaggccagctttgctggttggcaattattacgcccttggttggttacctggagtgacatgaaattttctgagagcatcttatatagcatatcctttgcctcctttgcaggaatcattgcaaagtcttccacttgcttctgctctatgtgtttcttctgcaaaactagacggaatattctagcacagcgagacccaaatctggaaaggaatgaagaaagcaaatggcatgctaacatagatcagctttagttcccagtcacagatggggtggttgttctattccatgtgtgaagccagtaccagacaggaacagtgatcagaaaattattctacagctccataggttggtgatggtaaggcatcaccaactgctgttaatcataaggcagtcaccaactgctgactcatttgagtgccacagttcctacatttgtaagcaaaggctttagggaggctggttaatttgcatcggtaggaattaaacagtaggttattttaaggtaaagagcagtattacatgagatccataggagtccagtgaaaaaatggggaaaagtatgccaaggtgtggttatattggtggcttacataatgatcaaattacttcactggggataggaagtatgtgatcccaaacccaaccagtgtcccccttacctctcctgtacgacggactccagagtggctgtggctagggatgctaatgccttatggaggtctttatgtagagaattaaggtcactcagtaatgttttggcctagttattgtgatctgagttttattcctaagtttctaatttataattaaattttaaatgctattttgtttttcatgttataatttatggtttcagtcatggtacataaatattccaaaactttaatacaagtgtttaagtaagggttttgcttaactaaaatttggttgattaaaagtcctttttccttttcttttttgagacagggtcacccaggttggagtacagtggcatgatctcagcttactgcaacgtctgtctcctgggctctagcgatcctcccacctcagcctcctgaggagctggactacaagcatgcatcgttacatctggctagtttttgtatttttggtagagatggggttttgccatgttgcttagctgatcttgaactcctgggttcatgcaattcacctgcctcagcctcccaaagtccaccatgcctggcctctttttacttcatcatcaatgcagttcactgaaaattcatagaaaaatttatttaacaattacttcaattttctaatttatttagtataataaacattaccaaatctttctttcctaaggcaccattctgatttataggtcaggctgcctgactctaaggaaataactggtaaggatactgatgacatacattcctccaccactgtcgccagactttccaacaaactctagctattaagaaaaagagagagtgttaactgaacggaaagtccagtgattctgtttccaatggaacaaatctgaccaaaagtctgcagcaggtagccctcctatcaaatgatgtggagaaattgtctgggctggctaggtagagaataactctgcaggaggatgatactaggtatcagtgcagaaataaattatcaacagtacaggctaaagaaaaaagaaaaaaagcaaaaacagacttactggatcatctgccagcagagtgagatactgatcaagaacttgcttagagatgttatagccaacaggtagggatctgaagatctatggagcaaaggacacttaaaatgggtttgggaacttagaactcctgaccttactgaaataaagatgttttaggccgggcacagtggctaaggcctgtaatccgaacactttgggaggctgaggcaggtggatcactttgggtcaagagttggagaccagcctgaccaatatggtgaaaccccgtctctagtaaaaatacagaattagctggacgtggtggcgcatgcctgtaatcccagctatttgggaggctgaggcaggagaactgcttgaacctgggaggcagaggttgcagtgagccgagattgcgccaatggactccagcctgggctacaagggcgaaactccgtctcaaaaaaaaaaaaaaaaaagttttaattttagttaccacaaaactgtccaaaaatattcacagcaggattgtttgtaagagtaaaaaactagaaacacccaaatgaccagtaccgagtacactaaaataaaatatagcacggccattaagtggaatatgatacagtcattatgaagagtgagacaaatctacagaaactaacatgaaaggaagttttacatacactgtcatataaaaaatcaagttatagaacagtatgactaggttgggtgtggtggatcacgactttgtaatgccagcactttgagaggctgaggtgggaggatcacttgatgtcaggagttcgagaccagcctggccaacacagtgaaaccctgtctctactaaaaatacaaaaattagcctggcgtggtggcatgtgcctgtgatctcagctactcggaaggatgagcaggagaatgccttgaacccaggaggcggaggttgcagtgagctgagattgcgctactgcactccagcctgggtgaaagagtacaagactctgtcacaaaaaaacaaaaacaaacaaacaaaacccaaccaaaaagccatatgaatagtcccattttggggttaaaaaatacatatacccacatatatgttagagtatgcaaggtctgaataaagatatataccaaactttttttttttttttgagacagagtctcactctgtttcccaggctagagtgcagtggtgcgatctcagctcactgcaacctcccattcccgggttcaagcgattctcctgcctcagcctcccaagtagctgggattacaggcgcccatcaccatgcctggctaatttctgtaattttagtagagatgaggtttcaccatgttggactatgctggtcttgaactcctcaggtgatctgcctgcctcggccacccaaagtactgggattacgggtgtgagctgctgcgtccggcctttttttttttttttttttttttgaaatagggttttgctctgttgtttaagctggagtgcagtggcatgatcatagttgactgcaacctcaactcttgggctcaagcaatcctcctgcctcagcctctcgaatagctgtgactacaggcatatggcaccacacccaactaattttttaaaaaaattttttgtagagacgggggtcttgtcatgttgcccaggttggtcttcaactcctggcctcaagggatccttctgcctcaacctcccaaagttctaggattacaagtgtgagtcactgcacctggccacagaactttaaaataaacaatataaaaatataggaatatttaaacatagtcatgcaccatataacattttagtcaacaacggaccgtgtgcagctgtggtcccatattatactggagctgaaaaattcctactgctttgtgatgtcatagctgttgtaacatcatagcacaatgccgttgtgaaacacattactcacatgtgtggtgaggctggagtgcagtggtatgatcttggctcactgcaacctctgcctcctgggttcaagcaattctcctgcctcagcctcccgagtagctgggaccacaggcgcatgccaccatgcccggctaattttttttttttttttttgtattttagtagatgggtttcaccatgttgcccaggctggtctcaaacgcctgagctcaggcaacccaccagcctgggcctcccaaagtgctaggattacaggcgtgagccaccccgctcagcctgttactggtttttaataaatacagtgtagcctgagcgtgtagaccatcacattcacattaatctgccattcattcactaactcccacagggcaacttttagtcctgaaagctccattcatgttaagtgcactaaacaggtgtggtttttaatttttcataccatatttttactgtaccttttctgtgattagatgtttagatacacagatgctactgcgttacaactgcctacagtattcagtacagtaacatgctgtacaggtttacagcctagaagccataggctatcccgttcagtctaggtgtgctgtagggctacaccatctaggtttgtgttaagtacaccctatgatgttcacacaatgatgaaatcacctaacgacacatttctcagaatgtatccctgctgttaagtgatgcatgactgtattactatgaaagtaatataaataacacatattggatatattaaatatcgatattttaagtacagggggtcaaataatgtcctgaatgccaaggctctcagagtccaaattgtggattcttaaaataattaggaataggctgtacttgacgaatagatactttgactaagtgaatagtgtagatttttaaaagctggatcctaagagaccaaacatttcagtgctcatcacttgaagataatccctgctccacatcaaatgcccttctctttcaaggctcagacctcaacccaaactcaggatctgtgtataataaacgttgataacacccaagaatctgtcagaaagttagtgcaagaacatgaaactcacctcattggaagacaatggctgggtgaagggagcactagaggaagtggtaatctcactcattcggagcatggttcgcacaatctcgctgcttgtctgtttgaaaagtaaactagaattcagaaatcacagtgctgcccctggctctatgtgccaatggccatatctgacaaataagtaaatgtccctgatgaccaatgacagacccacttaggtattacctggtccatcctgttagcaactgcgctcacaatggcttggtcacggaagtgttggtggaatctgtcaaggttggcctgccaataaatcccatcatctggaatgggctgaggaagagatttagagaaacatttagctatagtgtaaagttttctggtgaggagcttggatttaatggttcaccatttcttttcctacacagtaacaattacattggttggaaaaaaatcattcagtcatgtagactggtgtctagacaaattccgacttcaaacaggttttctaagctcatctccaatctttctctccctattttattatttaacatttattttaatttttttctgagacggagttttgctcgtcacccaggctggagtgcagtggcatgatctcggctcactgcaacctctgcctctcgggttcaagtgattctcctgtctcagcctactgagtagttgggattacaggcaaccaccactgcgctaggctaatttttgtatttttagtagagttggggttttacaatgttggccaggctggtctcgaactcctgacctcaggtgatctgcctgcctcggactccaagtgctgggattataggtgtgagccaccacatccggcctttctctctctattttaactcttctccattactttcaagtctccaacttgacccttcttccttctcactctcggcagatgactttgcctctcatttcacagagaaaatagaagacactaggccagaactcactcagctctgtgcacatcctcaccacatttcttttttgttcttgattcatattttcactcacttttatcacagctgaaaaatgctccttttacctaaggttaatgcccatattggtattccaaatcttactctctcattcattcttggggatccagctctattttaccctgtcctctaacatcttcaggctttccttctctaccgccttcttatcagcctttaccctgtccaagtctctttctactctagaattctctttcaaccctatgccttctcttcttttccttactgtcacagccaagcttctcaaacagttggccatctcagttgtatctctacctagatttacgcaacccatttccactattgtactgaaatgtcaattgtcactcgcattccagtgaaattccacaactgtccttaaggattctatgttgttaagttcaaataataatttccacttctgatcttatttaaccttttggaagcatatgacatggttggacattttttccttcttaaaactttatgtggctccttggttttatgacaccattttttttttccttttaaagacagggtctttgtcacccaggctggagtgcagtggtgtgattgtagctcactgcagccttgacctccctgggctcaggtgatcctctcatctcagcctcccaagcagctgggaccacaggtgcgtgccaccacgcttgggtaatttttgtatttttctgtagagacggtctcaccatgttgctcaggatggtctcaaattcctaggctcaagcgatctgcccgccttggccttccaaagtgttaggattacaagtgtgagccactgggcctggccgacaccattttttcttggcgttactttgaacctttctggctacctttcctcagtatccacagattcctctttcagatcccaactgtaatcctggtgttttgtcagggttctgtccatacctttcctttctttttactctacatgctctacttgggtaattttatctgctctccaggcttcaactattgatgcatttccaaatctgttactctatcctagaactctctcttttttttttttttttttgagatggagttttgctctttcgcccaggctggagtgaagtggcacaatctccgctcactgcaacctctgccccccaggttcaagcgattctcctgcctcagcttcccaagtagctgggattacaggcctgcgccaccatgcatggctaatttttgtatttttagtagagacggggtttcgccatcttggccaggctggtctcgaactcctgacctcaggtgatccacctgcctctgcctcccaaagtgctaggattacaggcattaccgcacccggcctatcctggaactctctattatgctccagatgcatagactcagctgcctatttgacacttccatttgttccccaaactgttctgttttgtaagttttcaggtaactacactataaccaacccaatttttttttttttttgagacagggtcttgctctgttgcccaggctgtagtgcagtggcaccatcatggctcactgaagccttgacttcctgggctcaagtgatcctcccacctcagcccctgagtagctgggactacaaacatgtgccaccaggtctggtgtttttttttttggtacagatggggtctcactatgttgtccaggctggtctcaaactcctgggctcaagtgattcttctacgtcagcctcccaaaatgctgggattacaggcacgagccactgtgcctagacaacccaatttcttttttttttttgagatggagtcttgctctgtcaccaaggatggagtgcagtggcgtgatctcagctcactgcaacccctgcctcccaggttcaggccattatcctgccgcagcctcccaagtagctgtaattacaggcacctaccaccatggccggttaatttttgtatttttagtagagacggggtttcaccatgttgaccaggctcatctcgaactctgacctcaggtgatccacctacctcggcctcccaaagtgctgggattacaggtgtgagccactgtgcttggccagccaacccgatttcttaagctacaaacttgggtatcacccctagtcccttgctctccataatctaccaccccattaccaagttctatctattctttatatttatcagatgtctacttttctttctcctatcattaccttatttcagactctaaatcttggcccatctggattactacaatagcctcctaactgggtttttttttttccctttaaaacatagcagacactataaaaggagtaactgggttttctccttctaattttgttttgcatcattcttcccatttcttagagtagtgcttttttttttttaaactgttttgggtcacagttcctttgaagaatgtaatgaaaggtacggagagcttcactgaaaaatgcacgtaagtataactggactctctgaaatccatccatggagtagaacaagttaggaactgctgtgctataataatctttctaaaatataaatccagtcacttcatttccctgcttaaaatccatcaatggctctcctttgccttcaggataaagcccaaacctcttagacaaacatgtacacaaataataaataattccagttataaatataaatgctgtgaagtatatgaaatgagaaatgtggtaggaactagtgtaggagtgggcaatggtgcttgaagtctatgaaaacagcatttaagatagaaatgataaaaacagagaccactacatgaagatctggggacaaacatttgaagccggagccaaagtctaaagaccagaaagagtttgacatgtttaagagataaagtcagtagagggaacacagtgagtaagatggagacggggcagaggtgaggttgaagagccctgtctccagcagatcatacgaagacctagatcacgtaaggcttcctagcccgtaccttggatttcttctaaaagtaaaggaaagctattaaaggagtctaatcagtggatgtgttgttttgttttgaacaacttagaaagtcattttggctactaagtaggtaagaatgcagctagggagaccattaacgaaagcgtttgcaaagagttgagagatggcagtgaaaagatgagaaatggttggatttgaggtaattttggaaactgggctgatatgttttactgtgagattagagggttccaaggattttggcttaagcagaaatggtggtgtcctaggcggctggcctacgtggtagtgtcttttactaagatgaggaagtttatgagggagcaagatatttgggaggaggaatcaattattctgttttggccacactaaatttgagatgcttactgacatctttataggtacgctaagaaggcatttgaatatgagttcaggcctatgtatagtttttagacccatttttcatcactggcccctgtaggtctttaggttctcgccatattgagcaacctaaactttttctaggcccctttttacataagctgttacctctgttcaatgaaagaattaagttaaggctcagaagggagacagtaatggttcattctttgttagtctattcctaatatttaatgaggttcataatcctactgcttcttagctcaggaagctttaagctctcttggggcttgttatctgagtgctctttctggcctgcttcagggtgaggacttctaatcaagaagccccattacctccttgttatctgtagtatattttggtctcttggccttgggctccccagcagcatcttcatcagatgatctcctccttttacctttccctgccaaacaaacaattaaacacttagactatatctcatatgatgacaggaaatgaccaaacatgagagcaggtgtctttcattccaaagacatctgtagctgcctctagatcagagttgcttagggggctgaagagctataagaaactcaagtaactgatgaaataatctgaaactcaacatgttcaaaaagagtcttatagtctttctcctccaatgctctctttcatggccagtgatatcatcctcccacatgtgcaagtcagacacacagatgtcactcttagtacttgtttccttcaccctctctctttcattttccaccagtctgtcaacatttacctttgccccattctcccatcctttctgtagacaaaaaatcttttgaaagtgcaaattagatcatgtcatttccttaaaaatccttcagtggtcttcctttgctcttagcataaagaacagatgctctataaggtcttacttgattcagcccctgcctgtctcccatccaagtactaagcaggttgatcctgattagcttctgagatcagacccctgcctagctatgtctctaaccttacctcatgcctctcttgctttgcttacaatgctttagctatactgacattctttcatttcctcaaatgctatttttttactacatactattccctctgccaaaaatgcttttcctgttacctcactgttagcttctacttcaaatcttagctcaaatgccaccttctcaaagaaacatgaggcctaaactcccagatgaatcccgtctctcgttatatattttcttttcttttttttttcccgagacagagtctcactctgtcacccaggctggagtacagtggtgcaatcttggctcactgcaatcgctgtctcctgggttcaagcaattctcctgccccagcctcccgagtagctgggattacaggcgtatgccaccatacctggctaatttttttttttttttttttttgagacggagtctggctctgttgcccaggctggagtgcagtggcacgatctcggctcactgcaacctccgcttcccgggttcatgccattttcctgcctcagcctcccaagtagctgggactacagatgcccgccaccacacccagctaattttttgtatttttagtatagacggggtttcccggtattagccaggatggtctcgatctcctgacctcgtgatccgcccaccttggcctcccaaagtgctgggattacaggcgtgaaccaccatgcccggctacctggctaatttttataattttagtagagatggggtttcaacatgttgcccaggctggtctcgaactcctggcctcatgcaattcgcctgcctcagtctcccaaagtctccattatatattttcataacacctcatacttttccttcatggcacttattacagtttaattatatactgatgtgattttctgattaatgcatgtctcataatactatgacagttccttcataggaatatttccttcatagtacttatcaccgtttaatgatatatcgatgtgattttccgattaatgtatgtctcctatactaaagccccatggcagagaccatgattttttcattgttatacaccacgatgtctggcacatagcaaatacttggtaaatacaatcacatttcatacacttgacaatcaagaagaatccacaattaaggcaagtcacagttccaggggttaaaattccttacctatcaagctgagtttaggaaccaggtacatgtccttttcattaatgacaagtgtgggggcaggtggtggtggcccagggtctgaattctcagtggtaggtaccgaagggcagcgttgtacaaagtgtgtgtctgccagtcgcacaaatgtgtttgatacttcagcatagtccatggtcttgccatctgtataacaggaggaaaaaggcagatgagatggcctaagatagctcagggttcactcccatagccagctgatctatgcttttgttaacagctatggataccatactgaccctccatggtctctgtgagccggtctgccactttcttcacaacagctgacattgtcagtttgccgttcaacagaagctcctcaacaatcagctctccagtgtcactgtacagagttttggtagtatagatgtaccggggatatctaagcattcgcaatacccggctgcactgggcttcatactccaccacaccacgtttgtgcacttgataactcaccaggttatgttggacgaggacacacagggctttcttcacctaaatggaacataaagagaagaaagagaggaaagacctgaagatatagctcattactgctggcaattttttgtccaacagcttagtaagcatcagaaaatggctagataatttctgcacttatttcctctctccactggaggagctaataagaatcacacatcaatacaataaatcaggaagattccttgctatatttcctctgatccttatctctcaaaacacaatttactttcatcattctcattccttaaaggcagtactgagattaatagacttattgtgaataaatgaggtacggcatgggaagagcaaagatttgcctaaaagctgtgatgaactaggaacactttgagaaacaaaatgttgatgtctaagtctcatccttttctccccgaaataacattgttctgctccaagggcaggctttcttcatttttccttttctggggtgagaagaacaatattcaaaggtgggtgaaataaattagtgaaagaaatgagagaaaatgaatgtcatttagacatacctgatccagtgatgttcctgtgtcatgggcaattactcttagtggctggctgccggttcttatcagatggactccaattttttctacaatctctccaaaatgctcttgcagcaacaaagaacagagcttaatttctgcttgagtcattgtactggggagtctgagagctagggaaaaaacaccaaaatggtacaatagaaagtctttcacgctggaagcagagctgctgagtgtaaattcatgtattctttctggagggcaatttgacaatacatatcaaaaagccttaaaaatcttgcatatctttgaaacaacaatttctttttggatattgtgtccaaagaaagaaaaagctaataataatgaagtcattagttctctttataataccgacttagtggaaacaatctaacgtctaacaataaatgatgccatacccatacaatggcatactacaccaacatttaaagttatttagtacgatgcgtattcatgtagaaaattattcataataggctggcgcggtggctcaggcctgtaatcctagcactttgggagaccgaggtgggcgtatcatgaggtcaggagtttgagaccagcctggccaatatagtgaaaccccttctctactaaaaacacacaaaaaaattagctgggcgtggtggcgggtgcctgtaatcccagctactagggaggctgagacaggagaatcgcttgaagccgggaggcagaggttgcagtgagccgagatcgcgccactgcactccaacccgggcgacagtgcgagattctgtctccaaaacaaaaaaaaccaaaaaaaattactcataatatattaagtgacagaagcaagctgaaaaaatataaaaattcaattattgtaaaaaaaaaggaaaaatgtatgcataggaaaagactatgcatcaaatttatctctatgggattatgcgtgattctgattttccttaaagattgggagatgattttgcggtctgtcacagaccttagtttctacacttccctgcttggaagaattaaggtcactgttcacagctcggtgggagtgaacaggcagtgttattctcagtccataaaggaaatgataatttcgaaaaagaaatttaggaggtaaaggactgcttctcaacagggtgtgtcaaacaggagatgaggttacgttgtttgcaggacagtattcaattcttaaacttctactccttgacaaagttgacacaatcagaaacggacgtagttaattttatgattacttccttattacaaattgctaccaaacattgtttacttatttcttccaattcctaagaagccaagtctttgcctccccgtccccaccccgcctcagtatcaccagagacctatttcgtccatccacatatctttggagaagcattcccagatcctttgccatcctcggaaagggcttccaaggcgcttggctcctagctctacacttcctttacacaggttcccgtttcggacgtggtctcttggtccagtcagtgccgccacgttcagacagcattttccactaacctcagggtcagcgcaatccgggggctccaactccaattcggctgagcttcccgcgacggcttcctacggctcccgctggccttctaggccgaggtggagcccaccgccctttctaggacgcggatcgccaccgaagaagacgcggaaaagcaaaaagcgcgtgccactctaccccagagtttcggcggcttccggggacgctctttctttcttctcgctggaagactggaggaccagcgaggggctgtttgtggagccggcgggcgggccgtttgtctctccttcctgcgcctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggtaagagcgctgtgttctctatacttgggaacctcatagattcctggccccgatttcccggaactgggtctggagctttctgcacatcattgactcgcccgacatcggtctgccgaatacctgctgcccacttctaagccgccggccctaaaccctgggcatcacggcctcggccccgtacctcctgcccacctcttaattcatcctgggctgctccacctgacctcacctctttacctcccgtgtccttaatttttttttttcttagcaagtttccctctgataactctcccctcaattttcttgcattcttttatacctggtctttttcctacgatgacctccccccacacttcttccactgtgtcttctcaccttcctctgtgttcttttccacttttcaccccccaccgcccccgccacctcccttgtcagtgaagcgaaatagcggattgctgaggattgtcactcttcggttttttctagggaaggaagcacagaaagggggttggaaggtatctgtggggcgaaaagggggattttgctcttcagtggtttccagggtccttgtgacagtgaagacagcagcgtactaatgacttgcagacggtctgcactcctatcactgttgaaggaaatggctttaggaagaaggcaggacgtactgtttcaacttcgtttattttggttgtcatgctgccagtgtctttaatatcattgttccgccccccgccctgtccctttcttcacctaagaaaaagagccgggacagaatgttggggatgcttcctctgacgtgaaattggttttcacgagtttctgccagagtgttagccccttgagaggcagtgctgtggttgggaagaaaacacttttgtaggtcaggcgcggtggcttaggtctgtaatcccagtgctttgggaggacgaggcaggaggattgcttgaggccaggagtttgagaccagcctgggcaacagagtgagacccctctctacaaaaacaaacaacatttatgcagcatactagccagcaccagcatcacaaacccagaagctgttttgggttgggttgtagctactacgaggagctcccccagagtgaatgtcaatcctgtccttggccaactgtctttatggttgttcctttccttacaagtgtccaggttcagtcttgtgatagagtggcaacattatgtttctatttatggtgtctcagatacagtgtaggagaaaaccttctgaagtgagtctgtatatcttatttcttagaaacacaaatggagtccagtgaataagtgcttaaagggtgttttatagtcttctctcactcaaaagttttgtttaaggcattatgatacattctttcctctctacttgccgcaccccctacttcagagtcatagtttcatctaaatgctacttagctgtttttcttttttcttttttttttttgagacagcctctgtctatcacccaggagcatgatttcggctgactgcaacctccacctgccgggttcaagagagtctcctgcctcggcctccgggtagctgggactataggtgcacgaccaccgcaccctggctaatttttgtgtttttagtagagatgcagtttcaccatgttggccaggctggtctcgaactcttgacctcaagtgatccacccgactcgggctcccagagtgctgggattacaggcgtgagccactgctccccgcctaaatgctacttagctttgtttgctgattttgctgtgtgtttatgtttttttttttggccatatttcagtgctgggaagagcaggtgtctagtttttttccagccaacatcagagcctgcagaactcttttaccatagagagggagtctggaattcagccagtatgtgtgtgaccagtggtgtgttgttgaatgtgatgccttgttgaatattccatccttagcttttttgatctttaagttgctgttcactattttgcctttaagagtgagaagttggccaggcgtggtggctcaggcctgtaatcccaatactttgggagtccaaggcaggcagatcgcttgagctcaggagttcgagactagcctgggcaacatggagaaaccccgtctctaccaaaaaataaaaaaatttgccgtgtgtgtggtggcatgcacctgtagtcccagctattcaggaggctgaggtaggaggattgcctgaccccaggaagcagaggttgcagtgagctgagatcgcaccattgcactccagcctgggcaatagagccagaccctgtctcaaaaaaaaaaaaaaaaaaaaaagagtgagaagacagtctaaacttccccaattgattatatcttttcttctcacctttaagtccttacttcaaagggataatttgaaaagctgaataggtgtttttctaagccttagttaatgcctggagaagtttcttgatctttttggtgtgatatattatttgtcatatctgatttgtaaattgaggcctaacacaattgagtataaccggattcttcctaaatatatccaaggttctctgctgagtgtcctggaggtgatagggagtgatatgtggctcctgcccttaaggatcttacagcttttggggaaagacaaggcaaacatagaaaaagtaacagcataaagggaatgaggatatgtgctttaggattcagagaggggaatttcatagcgttggtgtggccagtgggatttaaattgagttttgagggatgggtgcatttcagattgagaattccaaagactgtgaggtagcaaaaggaagagggagttgatgaagaagggagaaatatttaataaatcatgtttttttcacaactaaaagttgtatactatattttttatagtgttcagcatgatttgatatatgtatacactgaatggttaaatcaagctatttaacatgcattacctcacatacttatttttgcgtggtgagaacacttaaaatctgtcttagcaattttcaaatatacagtatattccctttttctttttttgagactgagtctcgctctgtcaccaggctggagtgcagtggtgcgatctcggttcactacaacctccacctcctgggttcaagcagttctcctgcctcggcctcccaagtagtggggactacaggcacgtgccaccatgcccagctaatttttgtatttttagtagagacggggtttcaccatgttggccaggatggtctccatctcgaccttgtgatatgcccaccttggcctcccaaagtggtgggattacaggtgtgagccactgcacccggcctctttctttctttttaaatagagacagaatttattctgtcttgttgcccaggctgttcttgaatttgtgggctcaatgtgtcctcccactatatcctcctgagtagtagtagataggtgtgttccaccatgcctggctaatttttttttcttttttgtagagatgggattttgccatgttgccccggctggtctcaaatttctgggcttaagcaatctgcctgcctcagcctcccaaagtgctggggttacaggcatgagctattgcggctggcctgatatgtggtatttgtttttaattctgtttatgtgatgaatcacatttattgatttgcctatgttgaactaaccttgcatcccaggagtaaagactacttgattgtggtagattagcttttaatttttatttatttatttttttgagatggagtcttgctctttagcccaggctggagtgcagtggaacgagctcagctcactgcaacctctgcctcctgggttcaagcgattctcgtgcctcagcctcccagatacctgggattacaggtttgcaccactagacctggctaatttttgtatttttggtagagatggggtttccccgtgttggccgggttggctttgaaatcctgacctcaagtgatctgcctgccttggccccccaaagtgctgagattacaggtgtgagccaccacactggcctgcattagctttttaatgtgctgctggttcagtttgttagtattttatttagaatttttgtgtctgtgttcattagggatattggcccggagttttcttttttcattgtgtctttgccaggttttggtatcagaatgctgctggcctcatggaatgggttagggaagagtccctcctcgattttttggaataatttcagtaggattggtacaagctcttcttcgtgtctggtggggtttggctgtgagtccgtctggtccagggccttttctgattggtaagttttttatttttcattattttttgagacagggtctcactgtgtcgcccatactggagttcagtggcatgatcacggctcactgctgcagcctcgacttcccagactcaggtgatcctcccaccttagcctcctgagtagctggacctacgggtatgtgctaccacacctggctgttttttttttttttttgagagataaggtttcgtcatgttgcccagcctggtcttgaactcctaggctcaagcgatccgcctgcctttgcctcccaaagtgctgggattgtaggcatgagccatggccctggccaggttttttattactgattcaattttggaactcgtcattggtctgttcagaatttcagtttcttcctggttcagtcttgtgaggttgtatgtttccaggaatttatctggaattttaggttttctagtttgtgtgcataaaggtgtttgtaatagtctctgagggttctttgtatttctgtgggattggtggtaatgtcagttttgtcatttctgatggtgtttatttagatcgtctctctttttttctttattaatctagctagtggtctatcaattttattttttgaaagaaccaacttttggtttcgtttatcatttatttgtatggattttcgcatctcaatttcattcagttcagcactgattttggttatttcttctgctggctttggggttggtttgttcttgtttttctagtttctctaggtgtgatgttaggttgttaatttgagatctttctagctttttgatggaagtgtttagtgctataaactttcctcttaatactgctttaactgtatcctagtgattctggtatgctgtatctttgttttcattagtttcaaagaactttctgatttctcccttaatttcattttttactgaaaagtcattcaggaacaagttgtctcatttccatgtaattgtatagttttgagagacctttttagtattgatttctattttaattgcactataatccgagagtgtggttggtatgattttggtttttttgcctacgcacttctcaaaagaagacatatatgcagcccaataagcatatgaaaaaatgctcaggattactaatcgtcagagaaatgcaaaccaaaaccacagcgagataccatctcacaccagtcagaatagctattattagaaagttaaagaataacagttgttggcaaggttgtggagaaaagggaatgcctatacactgccggtgagaatgtaaattagttcagccactgtggaaggcagtttgatttcccaaagaacttaaaacggaactaccattctgcccagcaatccattactgggtatatacccagaggaatataaatcgttttaccaaaaagacacatgcacttgtatgtttattgtggcactgttcacaagagcaaagacatggaatcaacctagatgcccatcagtggtggacttaataaagaaaatgtggtacatatacatcatgggatactatacagctatttaaaaaaaacaaaaccgaaatcatgtcctttgcagcaacatggatgcagctggaggtcattatcctaagtgaattaaagcaggaacagaaagccaagtaccacgtgttctcacttaaaagtgggagctaaacattgagtacacatgggcataaacatggacacgagggcttacttgaggtggtgagggtaagaggaggatgagggtcaaaaaactgcctatcttgtactatggtcagttgctgggtgacgaaataatcagtacaccaaattccagtgacacagtttatccgtgtaacaaatgtacatatgtgcccccaaacctaaaatcaaaaaaaatatgtgtagaaaacaaagagcaaaatgaaggacctaaaacctaaaaaccatttatagtcaatatataaaaaggcttaataccccagttaaaatcagatatggataaattttataaaaacaaagtaaacaaagagggtactgactcttgtgatagttggataccaagaaccatccctcactggggcatgctgtggctcacacctgttataccaacactttgggaacccaaggcaggagaggattgcttgagcccaggagtttggcactagcctgggcaacaaagtgagaccctatctctacaaaaattaaaaaaattagccaggggtggtggtgtgtgtctgtggtcctagctactcaggaggctgagtcggggaagattgctcaagcccgggaggtcgaggctgcagtgagctgtgattgtgccattacactccagtctgggtgacagagcaagagcttatctcaaaaaagaaaaagactccatgatttaatctaatcaacttcaaaaacccaactcattcctccacacgccctgtgccttggccatagcatttacctcaccattctcctatgcattatctatttttagacctctgtctccctttgtttaaaatgttctcccagcctggataacatagcaagaccctgtctcaacaaaaaaaataaaaattagctgggtatggtggcatgtgcttgtagtcctagctacttgggaggctgaggtggaagaattacttgagcccaggatatttgaggttacagtgagctatggttgtgccactgtactccagcctgggcaacagagacccagtctggatgagagagaagagagaggggagagaggagagaaaaaagaaaagaaaagaaaaagaaaaagaaagaaagaacccatcatctatgagtgctgtcctcactgaacaccagaggctgggtattgagtttacatcagcttttaatgagctctcactaggtttcttcacccattcaatgggaaggtctgcttcagagccataattgtgttcaacgggactaggttgcaaggtttaataactcttctcttctttttaaaatttaattactttattatttcacctttttttttaaagccacatgtaggctgaattcatttaatttgacagaataacactccttactgctaatcctgatcaattttagctttgtgtgtctttgggttggatccactcagataagaggacaaaagagggccgggcatggtgactagtgcctgtaatcctagcactttgggaggccaaggtgggcggatcacctgaggtcaggacttcaaaaccagcctggccaacatggtgaaacccctgtctctactaaaaatacaaaaattagcctggcgtggtggtgggcgcctctaatctaagcaatttagtgatttgagctgggctcgggaggctgaggcaggagaatcgcttgaaaacccaggaggcggagcttgcagtgagctgagatcgtgccattgcactcgcaaaaagagcgagactccatctcaaaaaaaaaaaaaaaccattcaaaaagaggacaaaaggttcatttggaaagaggatattaagaaataaggagaaatcatgaagggaattttaaaatgaaaacatatttagtggcattgttttctgttaggtttcaaaaaagtctccattccaagtgagtattggtttaggaatttctttctccttattaaaagtgttttcctatttacagtgaaaataactttagtaaaattttgtgagtactaaacttggattttaaaatcagagatttcgattatatagtctggagcctcaggattttaagtttctgtaggattgggtaaaatgccattgtagattttttggtcatcagattatagaataaatacttaaagtaacttcagattattattttcaaaaccatagcagaaactcttaccttacctatcttattgagagacaatgtgaagccaagactaatggagttagtgtgctacattgatgatgaatgactgggtagtacaccacagagggctgtgtcatggagtgtaaaggtgttattccattcctacaccctaccatccgtctttccccattaaatcaaggtcagggaatgttaccttatgtgattaaatctggtagagtcatcattaaacaggtgagataaatcatatgcagagtaacctacttttggtattgatgagactagggtggttcttaagtattttatggagatcagggtatcttcctaaatccagatgaagagatcaggttaagaactgctcgctttcaggctccacctgaagaaactatgtagtaggcttctctccctctacttattttatcatcttctttgatctaataaaatgttttccttatcaataagtaatgttatctagtttggctctaccaggtgctagagaaggcattcatcattgtattgtacttgcaataactctaatacaggaaaatgttcaaaccacccataataaaagtagctaaaaagcagatttcttaaagactttgtgaccgtttaagctcagctgacctttctaagttgcatgattcttagaaaggtcccagagagatgtctatctggtgctatatagcagttgctaattaaatattttttaattgaatgattgatatgagttgaacacccagtaattatatttaaaaagtgatgacttcagtgttttgacgcctttaaaaggctacagtggtacaaaatgtaggtgctaccatgtgaaatttgaatgtacagtgaagtacatatattcactgcaatatctagaaataaatatgtattcttataggtagaggctagtttatccttgtaattctactgataaatataaatgtatatattggggaaatttgtgggactttttcagtataaggaagaaaaaaatctgaaaattgaactcactgcagaagaaattttttgtattttcgggggaagtaccaactagatgtgctaacactttgtatttctttatgtttagttgcctcttttttttttttttaaacggagtttccctctttcacccaggctggagtgcagtggcacgatctcggctcactgcatcctctgccttacagtttcaagtgattctcctgcctcagcctcccaagtagctgggattacaggcgcctgccaccacgcctggctaatttttgtatttttagtagagacgagggtttcaccatgttggccaggttggatctcttcacatcctactgagcaataaatgagatagcctagagcagtggttttcaatttcaggtagttttgtttcccggggaacatttggcaaagtctgtagacaattttttatcttttttttggagacagagtctgactttgttgcccaggttggagtgcagtggcatgatcacggctcactgcggcttccacctcctgggctcaagcaatcctcccacctcagcctcccaactagctgtaccaccacacccggctaattttttaattttttgtagagacagagtctcactgtgttgcctaggctggtgtcaaactcctggcctcaagcagtcctgcttcggcctcccaaagtattgggatggtaggtgtgagccaccacacccagcctgtagacatttttgatttttgtaactaggggctggaggagggttgctactgtcatgcagtgggtggaggccagagatgctgctgaacatgctgcagtgcacaggatagacccctcaaaacaaagaattatattgggcccaaaaaggtaagagggctgaggttgagaaaccctgggatagatagagggatagtcagtgtcatcttgtgctaattgtgtttaaggttttgttttggtgtaggtttgatttttaattttgggatcccagtgaattttcagtaagaaaattgagaccgtataattttaggcaaacctctgatgggagagagtgtttagaacaggaactagggctcagttagtggctgcaattccattatagcagtatctattggagttactttctgtctttggagttactgagaccagaggaattggattacccctctcaagttacatactgtaagggcaacttataaaagaaaactatccacatttttttgtcagttgggaattaattgagatagaaacactgcatgtaatttagtaagacagctggaaatcccagtttgaaaacaaaatgaaaagcagacaacaagcctaacttttagttttgctttctgtgtttctcttatacctctcagaagtttcataagctccagaaattttgtgtttaaccttttagtttcttcaaattcttggttgagagggtatattggagttattaatctttgttctaaaattcttcgggtgacttctcgctgagtcatctgaccgtctcagtttacctaagtatatcccattgtaaaatgatacttaggtgcacgtatgggaagcttgaatgaggaatggagctgtataatcctaattgaaaggcagtgtaagaatcatgagcaatccttatttgcagagaaatagggccattaccgtattagaagcattttaggttgttgttatagtttcacatacagaagtttaggtgctgaaaaattattcttttttagaaatttcttttttcaattgtttgctgttcagagtttctcagaggtccccagatgcatgtatatcagttagaagtaggacaggtatggtggctaacacctgtaatcccagcactttgggaggcagaggtgggtggataacttgagctcaggagtttgagaccagcctgggtgatatggcgaaaccccatctcttaaaaaaaaattaaaaaaagatagaagtgagttggcgccagtgatttttaaaccaggcatacttttcttgtatgataagtagactgttggtgactcttttcccaaaacagaccagttagattttgttttttgtttttttttgagacctgaagcctcactctgtcacccaggctggagtgcagtggtgtgatcttggctcactgcaacctccgcctcccacgttcaagcaattcttgtgcctcagcctcccgagtaactgagattatgggtgtgcgccaccacacctggctaatttttgtatttttagtagaggcggggtttcaccatgttggccaggctggtctcaaactcctgaccttgcaagtgatgcacctgcctcggccttccaaagtgctgggattacaggtgttagccaccacgcctggccagaccagttagttttgtcttccttgaaaatctgttaagacagattaatctctctccttgataatttgaacaagtgtcacaggaaacttcttagtagacaaggtaatgtttacctccttgccactcactttgatgttgtacagatttgaatagacttttaacccatagtaccatcttccagaagtttcattttgcttacctttcaccatgcttagaatttacattctcaaaagaaaaaacaattatagttacatgctctttcttaccttttgctggattaactgagacctgcaggtatcctacaatgatgctgatcttctagcccgttaattctcagacctctcagattcagtgccctcttcttataagtattttgaaatactctctttagtgaaatgaaatccacaggtaatacagcttttctacatatatgtgtgtgtgtgtatatatatatatatatatatatttttttttttttttttttgtgagacagaatctctgtcaaccaggctgcagtgcagtggcgtgatcttggctcactgtatcctctgcctcctgggtgcttcaagcgatgctcgtgcctcagccttccaagtagctgagattacaagcgtgcatcaccacacctggctaatttttttgtattattatttattctttgtagagacagggtttcaccatgttggccaggctggtctcgaactcctggcctcaagtgcgcccacctcggcctcccaaagtgctggggttataggcgtgagccaccacacccggccctacatatataattaaaaaaattatcttgcagtaagataaaggataaatagaaaatatttctgacagattagcttgacatgacagctacctgagtagactgctataagggtatttgcaacttaaataccaggagaagcaaaccagtacagtgaacaattctttgcaaatgtacaaataaaactcaagtacaacttctttcttcttcttcttttttcttttttttttttttttttttttggtagtgatggggtctcacttagttgcccaggctggttttgagttaggctcaagctgtcctcctccttggcctcccaaagtgctgagattacaaacgtgagccactgcatctgccccaaagtacagttttctcttactttattcagcagttgcttttctggacatttagtgcatgttaaaattatggactgggcacggtggcttacgcctgtaatcccagcactttgggataccaaggcggttggatcacttgagcccaggagttggagaacagcctgggcaacatggtaaaaccctgtctctacaaaaaatttttttaaaaattagccgggcttggtggcacgtgcctgaagtcccagctacctgggaggctgaggtgggaggattacctgagcccaagaggtcaaggctgtagtgaaccgtgatcacaccgctgcactccagcctgggtgacagagtgagaccctgtctcaaaaaataaataaataaataaataaaattatgcagaaggacttggtgcttatacgtagaatgtaattaggttctaggctttggtaattatacagattttaaaaatccagttaactattcataaggaagtttgagaataaagacattttttctttgtgctggacttgcctatgctttcctggcctctgccaattgaatgtcagtaacacttttttttttttctgcaacttttattttaagtcccggggcacatgtgcaggatgtgcaggttttgttatgtaggcaaacctgtgccatggtggttggctgcacagatcaactcatcacctagctattaagcccagcatccattagatattcttcctgaggctccctcaacaggccccagtgtgtgttgttccccaccatgtgtcctcctcatttagcccctacttacaaatgagaacgtgtgatgtgtggttttctgttcctatgttagtttgctgaggataacggcttccagctccatccacatccctgcaaagtaatcactcgtcctttttatggctgaatggtattccatggtgtatatgtaccacattttctttatctagtctctcactgatgggcatttgggtttattccatgtctttgctattgtgaatagtgagaagcacttcttaactgctgtgacaaccaaagcacttccatagatgtcccaactatcccctagatgattgtgttgtcctcattaagaatgacctctagtcatacaggaaaacatttttctgttttatcattcactcttcttttttttttcttgcttattattcactactttagcacagccttttagtctaaaagacaaagatttacttggcctttagacaattcctatatgtctttaaatttcttatttcctcaccactcttattattgatgttttcttttccataagtgttaggacagtgccttggtacatagtagatactcaattagtatttgttgaatgaaggaaacttaactgtaggctttttcttcttgccactttctgctttttgtacctgttgaaaatgatggaggtaccagtgttcataaaaaccttgaaaacaggctgggtgcagtggctcatgcctgtaatcccagcactttgggaggccgaggcaggcagatcactcgaggtcaggagttcaagaccaacctgatcaacatggtgaaaccccgtctgtactaaaaatacaaaattagccaggtatggtggcgcatgcctgtaatcccagctactcgggaggctgacgcagaagaattgcttgaacctggaaggtggagattgcagtgagccaagatcgcactactgcactccagcctgggcaacaagagtgaaagtcttgtctccaaaaaaaaaaaaaaaaaaaaaaattagctgggtctgggtgcagtggcgcacacctataatctcagcactttgggaggctgaagcgggcagatcacctgaggtcgggagtttgagaccagccagcatagtgaaatctgcatctactaaaagtacaaaaattagctgggtgtggtggcacatgcctgtaatcccagctacttgggaggctgagggaggataaccacttgaacccaggaggtggaggttgcagtgagctgaaattgcaccactgcactccagcctgggcaacagagtgagactctgtctcaaaaaaaaaaaaaaaaaatccttgaaaacaaagcacagacctgtagactaatgactaaagggttggctcaaagcagcagtttgatggaccacttgctattagttagtggccagtagagtggagcctcttgtggaatacggctttatttctgcatatgagagcttataagaagaggagtcatcccataattacatgcctttcagataaacagctgatgggctttgtaggcagagttactttaatgaagtcattaatagctgaatttgttgaatgaaagcttcttctagagaatcttttctaatttaggtactactgtgaggtatttttgctctcaaacttattaaactgttggttccctgattttgaatttatggtgccagttattagatcctgatctcttaatatggtcactgctaaatgtttacaggtattagcatacctagttaagacaagttaggttggggaacagaaatttttatatcttagcctcgttggtttgaaaaaaaattagttatttggattgctgatatagtgcaaaaactatttataatggtacatttactttctgtttaataacatgtaaaaggcaaacagcaaattaattttcactgctagtcttgatttgtatgttttagattaaagggttgttgaaactataataaaaaaccaaataatggttgggcaaaggaggacatgattagacatttctcaaaagaaggcatataaatggccaacaggtatatgaaacagtgcttaacatcactaatcatcagagaaatgcaaaccaaaaccagaatgagataccattataccccagttagaatggccattattaaaaagacaaaaataacagatgctgaccagaatgtggaagaaagggaactcttaaacactgttgatgagaatgtaaattagtatggtcactatggaaaacagaatggatatatttcaaaaaaaactgaaaactaccatacaatccagcaatcccgctactgggtagttatccagaggaaaagaaatcagtatatcaaagggatacttgcacttccatgttcattgtagtactattcacagcagcaaagacggaatcagagtatccatcagtggatgaatggataaagaaaatgtggtatatatatatatgcaagagaatagtgtttggccataagaaagaatgaagtcgtgccatttgtagcaacatggatggaactggaggttattatgttaagtgagataagccaggcacagaaagacaaatattgcatattcccactcatatgtgggagctaaaaaagttgatttcatgcaggtagagaatggaatgatatctgaggctgggaagggtgtgtgaaggcagagggggtgaggtatgtggataaagagaggttgattaatgggtataaacataaaattagatagaaggaataagttctgatgtttgatagcagagtagagtgactaaagttaacaacaatgtatatttcaaaatagctagatgagaggatttcagatattcccagcacatagaaatgataaatatttaaggtgatagatgccctaaatgccctgacttgatatgcatgtaccaaaatatcacatgtaccccatgaatatttacagatatctgtagcaataaaaaagtggttgaaagtaatattaataagtgagaatcataaaaatgtttaatttgctgaatttttcaaccttagtttactaatctttaaaattgttggtttattattctctatcaagtgcaggtgctgattgaatggatagggagaagttgttttaatattatattagcatcctattttaatatgcaatcagtattagatggacagattcagagttcctaaggtttttaataagattagcagtataatataggtctatctcgtcctgtaacactagtactgtaaaaggtttccagaagtatatctatttctattcctgagtgtgattgattctggatattttctttgaggacacacacatatactctatttgtgaagtacagcacttcgaatttagtttgtatttgataataacattaaaataacaggcactagattatgcaacagtaacagcagtccatttttatttattcagtaactgtattggtaccttctatattccaggagctgttctaggtacttgggctgttgtcttagtccattttgtgttgcttataaaggaataactgaagctgggtaacttaaaagaggtttacggctgggcgcagtggcgcgtacctgtaatcccagctgctcaggaggctgaggcaggagaattcttgaacccaggaggtggaggttgcagtgagccgagatcctgccactgcactccagcctgggcgacagaaaaagactctgtctcaacaaaaaataaacaaaagaagtttacttagctcattactctgcagacagtacaagaagcttcgcaccagcatctgcttctggtgggacctcaggaagcttccagtcatagtggaaggccaaggggaagcaggtgttccgcaaggcaagagagaaaggggaggggtaccacactcttttaaacaaccacatcactcattcctgtaaggactgcaccaagacattcatgagggatctgcgtccatgacctaaatacctcccactaggccctacctccaacattggggatcaaatttcaacatgagatttagaggggacacatatccaaactatatcagctatattcaggaagaagtacggagattaataaaatgttgagaaaaatgggtagtaaaatcaggatttaaatattttcttctccttttggctttctttaaatttaatatttatttatttatttatctattttatttttttgagatggagtcttcctctgttgcccaggctggagtgcagtggcacgatctcagctcactgaaacctctgcctcccgggttcaagcgattctcctgcttcagcttcctgagcagctgggattacaggtgtgggccacaatgcccagctaatttttgtatttttagtagagacggggtttcaccctgttggccaggctggtcttgaacacctgacctcaagtgatccacccgcctcagcttcccaaagtgctgggattatagtcgtgagccactgtgcctggacttaaatttaatatctcatttaaacattaaattaatgtagctatctctggattagagcaaatgcctttttgcccatttcaggtctgagatattgttgttgtaagaactaacaactagccctcattttgcaactgttgtcagccctttttatagctgattttatttattttaattaattatatataaattgtattctagtactgtgggaaaaaatgttttattttagctgttaaattattgaacctttcagggtcttcattttccttgtctgtaaaatgagatagttgtgtttattcctgctagctacggtttagtgatttgagctctggggtatttttggattttgtgtaagggaattttcttctgtagtttttccacatagatcatgtggtagccactgacatactaggatttaaattttacccctgaaataatctcctttatgagttacaaactattagtgcatattttatcttataatgatgaacagtcttgaaaatgttaggatggaggacataatgcaaagcaatgtcaaaattttccttttataaatcaaacaaagcaataatgctggtaatgttgactgaataaattaaaacttcattttttttttttttgaagacttgggattcagtaacaggtaaacttggcctggataattttttttttagaactattttataaatattctttgtttgctttgaggttgcatttacattgcttttgtttttaaagttgtattcagttaactgattgttttcttaatccaatggtcagtggctactgttaacaaccagtttgtatgtgatctttcctgacttgaatgttcctgctgtgagttgaattagatcatacttgtgaaattctcctatgtcattgatggcaagtcaatgctagaattccaagtattacttttatttcgatgaagagttctcagtcagaagctctgattgctctgtgggtacatggtaaaatagtactttttaaaatgaaatggtgatggtagatggtttttttttaaatatttatacttggcaaaataaaaaagctggcaatccttgcaggtttccaattttttaatttgaaaattgaactgctttatgggaaccaaaagtatggaaatcagtagtctagatcagtgtttctcaaactgtgtgccaggagatttaataggagttcagaattatggtaaaatattgcataccaaattgttgccctatctccatccctccacttccccttttatgacatggaatggcatattaatggttctgaaaaatcattcattaaagcagcatgtttgatatttagttcaggcttttctaaatctagtttttctccccaccttaaccactggttaatatcctgtgaaacgtggtttgagaaatattccatatccaaatcactcagaataatttattagaacctacagtttgttgagaatttagtatattcccagtactatctcatttagatgaagtgagctacccagtgtcacacaactggttggttattctgtgtttccagtccgattgtgtgtgtgtgtgtgtgtgtgtgtgtgtgcatgcatgcatgcatttaaggtggacaacatgatgttttgaagtgcacatacatagttgaaatgattaccagtccagctttgttttgcttcacattcattactctaaccacttaggctgttctgaagcattgcttagttctcatttcgaggctaagtacctaagactaggatattcagaagttcattttatatgccttttgacttccctaactactagaatgtggttaagggaagtatgattttatcagagcatatactttgtaggtgattttagtgacttttaatcccaggttatttttctttctacacaatgcttggaatgtagagcttagaatttttgctgagtgaatgaatgttgtcactttgtcaaagaagattctgtcagcctaagctaaaagcaagaaagtacattttacttctaaactattgtggtacacatcagagctaaacatctatactttttggctcatttatcattttatatttatgccactgggttgttccctttcttgctgcctttagtgtgagcaagccaaaaacactataaatcttttctgctatattatgttgtctgaggttaattaacattttctctggtaattcttgtagtcctgtgtgtttcttccttagaaaatttggcttcttgaccatctgatcaagcttgtatcaagtaacactttgtcttgtgacctgattttctgccttggtacacaatgagctaaagaagcttggttgattatgcactcctgtttggaatctgtaatgtcagtgttcaatcatggcctgaattaaggaacaaaatgataaaggtggctgggtgcggtggctcacgcctctaatcccagcactttgggaggctgaggcaggtggatcacttgaggtcaggagttcaacaccagcctggccaatgtggtgaaacccatctctactaaaaatacaaaaattagctgggcataatggcgggcacctgtattcccacctactgggaagctgaggtgggagaattgcttcagcctgggaggcagagtttgcagtgagccaagatcacgccactgcattccagcctgggcaacagagtgagactcagtctcaaaataaataaataaataaaggttgtgaatgtgaatgttactattcttagggggatgaaaccataaatcaaggtagttttattggcctggaactgaatcacagcccttcaaacagtatttaaattgtataggtatccttgtgtaacactgaaactgtggcctattgttttcctttttagtaaactgattttctttattaatagccaagtgaacaattgcttacaactccttgagctcagagaactaatttcaaaatgtttagactggaaactttctctttcttgtaatgaatgagaggtatgtcttccttaatttcttgaaggagagttgagagaaagaagtcagtgaggacagtatttgtactctagaaagagattttcacagagaccttgaggataatggtggaactgggaacagaactcagaagttctgttgtctttgttttggggttcacttgatgcttttgaaaagggaggaggatgtataacctggcttgaaaagggaaccagtctctttgacctagtgacgagacttagcatcagagtaaaagtatagtgggtactggcctaggagctgtgatgtgtggcaaacattttgtgttcttaatccttctaattagaaatttctgactgtcttgccatgtgatactcaaagagagtataaacaatagaatgtgactaacttaaaattgtggctgtcagactagacagaaaatgggcttcttttttttgacactttaatcaccattggaacttctgttttagataaaataaacactttaagttgataacgaagaggtagaaaaacatagctgtgaaattaggaaaaaagtagtaagtctttatattacatttgatgtactgaataagtattggatacaaacttgtataggtttcaagagtatttaaatttcacattatgtgacctgatataaataggtctgaatttgtagctccttgtcctctaaggtgtcacgtattgtgataactaatcctttgaaatacgggaggcaaaagaaataatgcattaaaaccacccttttcctttccttcctatatttctagtgctttgtgtcctcttgggctgttcttttaagtgggtaagcatcagggctaagctatgcttagggagttgttctcgattcagaacctgccactgagtatcttcactagagttgtttacagtaatcttttagagcctagggggaaagcagcttagtttggtggaaacagttgggttcctgtttccagtgattctaggtaagtaacttaggttttttgttatgcttttcttttacagatgggatgatagaaatgactcggctgggcgtggtggctcacgcctgtaatcccagcactttgggaggctaacatgagaggattgcttgagctcaggagttcgagactagcttgggcaacatggcaaaactccgtctctacaaaaaatataaaaattagctgggcgtaatggtatacacctgtagtcccagctactcgggaggctgaggtgggagaatctctggagcctgggaggcagaggttgcagtgagccgagatggtgccactgcactccagcctgggcaacagagcgagaccctgtctcagtttaaaaaaaaagagagaaatgagttactgaattagaaatgagttactgaaaaagagagaaatgagttactgaggggtaagatttcgtgactgcatacattggaaatattttggggagaggtttgttgtgaagacttgacgtattaataggtaagcgtaggatagatttccatagtgcctgacatataattggcatttgattattattcttgatttagtgttcctccctttaaaagcatagttattttctttctttctttctttttttttgacatggagtctcactctttcactcactgcaacctctgcctcctgggttcaagcaattctcctgcctcagcctgcacagtagctgggattacaggcatgtgccaccacgcctggctaatttttgtatttttagtagagacggggttttgccatgttgggccaggctcgaactcctggcctcaagtgatcctccctccgtggccttccaaagtgctgagattataggctgagccactgtgcctggcctaaaagcatagttattttcaatcagcatggtataatgaaaagaagatggaattttggattcaagaaagaccaaggtttaaagctccttttctttttctttttttttgagacggagtcttgctgtgcgctctgcgctgtgcccaggctggagtgcggtgtcgtaatcttggctcactgcaagccctgcctcttgggttcatgccattctcctgcctcagcctcttgagtagctgggactacaggctcccaacaccacgcccagctaatttttatgtatttttagtagagatggggtttcaccgtgttagccaggatggtctcgatctcctgactttgtgatctgcccgccttggccctcccaaagtgctgggattacaggcatgagccactgcgcccgtcctaaagctccttttcatcccttgggcaatgttctgattttctattattgcctaacaagtctatccaaaatgtagtggcttaatacaataacttattattatctctcatgtttctgtggattgacagggttcagctggacacttctccccttaaggtctttcatgtggttgtggtcagatagtacctggagatggggccatctgaagactctgccctaggctggatccaagatggtgttttccttttacttgtctgatgtctcagtgctctttgagatggcctctttatccagcagagtagcctaaacttatgtggctgctcagggttccaagagttaggaagtagaagttgccaggcagttaagggctttggaactggcatagtattgtatctattaaagaagtcacagggcctcccagattcaaggggcttgagaaataaactgcatgtctttaaagggagtgggaaggtcacattgcagaagaatatatgggctgagaggtcttattggggctgtctctggaaggccatctgggcacaattttttttcattttcttgtttgtaaaatagcaataacaatatttacctcacagagtggttaagtggaatagcacagtgtcaagcacatcatgtgtttagtaaatataagtagacttccccccttaattctctaatgtaacaaattacttctgatctacttttattttaaatggccgcaagtttgctcagtatatggtttggttaactgtttcttcacccgactatgtttctcagactgttgtaacttaaaacaaactttatcatggaaaatttcaaacacatcaaagtaaagagaataccacattaacagaataagggacaaaaactgcatcatcatctcaattcatgcagaaaaagcatttgatagatccagcatactttcatgataaaaacactcaactaggaatagaaggaaactcagcatatcaaagtgtatttatgaaaagcccacagtggctgggcctgttggctcatgcctgtaattccagcactctgggaggccaaggtgggaggatcacttgagtccaggagtttgagaccagcctgggcaacaaagtgagacctaatctctgcaaaaaataaacacaattagccaggcatggtgatgtacgcctatagtcctagctacttgggacgctttggtgggaggattggttgagtctgcagtgagcaaagatcgtaccatatcacttcagaatgggcaacagagcaagacccttcccaccctcacccaccccctccccccaacaaaaaaaagcccacagtgaacatctcattcagtggtgaaagaccgaaagctttccccctaacatcaggaacatggcaaagatgcccattcttgccactgctatttcaacatagtattaagagtcctggccagagccaatttaggcaagaaaaagaaaagcacccaaattagaaaggaagaagtaaaattatctctgttcacagatgatatgatcttatttgttgaaaacccggaagctggctgcagtggctcatgcctgtaatcccagcactttgggaggccgaggcaggcggatcacgaggtcaagagatcgagaccatcctggccaacatggtgaaaccccgtctttactaaaaatacaaaaattagctgggcatgatggcaggcatttgtagtcccagctactcgggaggctgaggcaggagatttgcttgaacccaggaggcagaggttgcagtgagccgagattgcgccactgcaccccagcctggtgacagagcgacactccatctaaaaaaaaaaagaaagaaaaccctaaacattccacaaaaaaccctgttataactaataaatgaattcagcaaagttgcaggatacaaaatcaacacacaaaaattagttatgtttccatacacagtgaacaacttgaaaaattaagaaaacaattccattaacagtagcatcagaaagaatgaaagttaggaatgaccctaaccaaagaagtgaaaaatttgaatattaaaaaccgtaaaatactgctgaaaagaattaaagagcatacaaataaatagaaagacatcctgtgttcatggattggaagacttaatattgttaagatatgaattcttcccaaagcgatctacagattcaacagaatacctatcaaaatcccaacagcattttttttgcaaatagaagtttcatcccaaaattaatttggaatctcacgttacccctaatagccagaacagttttcaaaaagaaaaacaaagctggaggactcaaactttctgatttcaaaatatattactaagctatggtaataaaactagtgtggtactggcataacaacagacatatagacaatggaatagagactccagaaataaacccttgcatatgtggtcagatgatcttggacagaggtgctaggacccctctgtggagcaaggacagtctcttcagcaaacagtgttgggaaaactggactttcacatacaaaacaaaaatttggactcatattttacactatatataaaaataaactcaaagtggattaaagacctaaatataagacctaaaactgtaaaactcctaaaagaaaacttagaggaaaggcttataacttaaaacttagaggaaaggctttataactttggatttggcagtgatttctggcatatgacaccataagcacaggcaacaaaaggaaaaataggcaaatgggactgcatcaaacttaaaaactttggtgcatcaatgaacacaatcaacttgaaaaggcaacctgtggaatgggagaaaatgtttgtaaattgtgtatctgttaaagtattaatatccagaatgtagaaagaacaacaactcaacaacaaaaaatcaaataaacagattaaaaaataggcaaatgacttgaatagtcatttctccaaagatgataaaccaatggtcaagacacatttgaaaagatgttcaacatcactaatcatcagagagatccaaatcaaaaccacaatgagatatcacctcacatccattaggatggctactattaaaaaacaaacagggaattacgagtgttagtgaagattatgagaaattggaactattcttgtgcactgttgggactgtaaaatggtgcaactgtgatggaaaacagcatggcagttcctcaaaaaattaaaaatagaattactatgtaatccatcaaactcatttctggatatgtatccagaagtattcaatgcaggacctcagagagatatttgcacacctatgctcatagcacattcaggatagctaagaggtgaaaacaacgcagatgtccttgatgaataaataaaatatggtatatacacacaatggaatattatttagctttaaaaaggaaataaatcctgtcatatgcgacagtgtgggtgaaccttgaggatattgtgttaagtgaaataagccagtcaaagacgaatactgtatgctttcacttatattaggtattattactgaaacaccagggatgtgttctaggttatgctgcttgctgcacagaaagccagttgctgagacgatgagttttgccagagaaggaggttttaattgggtgctgtagctgaggagagggtaactcagtctcaaatccatctccctggctgactacaattaagggcttatatagcagggaagaactgtaactacatgcaggaaaataggaattagggagagataaggaagagaagttggtcaacaggaagcaggaggtcacttaggcaatcatgatgggttgaggggtttgaggtttcattgtttagatgcagtgatctggtacgtttcagttccttgatatcatctgggagacctgatggttggtttcctgagaaaggaactcagataagacaaatgtaactttttcaagttttaagactgggagggtcaatttctatctttattcaaaagaaactataatggtcagttctatgggacagttaggttgttggtgtcagtatcaaaaattataaattcatagaaacagaggtagaatggtggttaccagggaatgaaggggagaaatgggttgttgttgtttaatgggtatagagtttcagttttgcaagatgagaaggttctggagatgtttcacagcagtgtgaatatacttaacacttctgaactgtacacttaaaaatggttaatatgggctgagtgtggtggctcatgcctgtaatcctagtattttgggaggctgaggcaggcagattgcttgagcttaggagttcaagaccagcctgggcaacgtggtgaagcctcatgtctacaaaaaatacaaaaattagccaggtgcagtggcatgcacctgtagtctcaggaggcggaagttacaatgagttgagatcatgccactgcgctccagcttgggtgacagagggagaccctgtctcagaaaaaaaaaaaaagttaagatgggaaatttttatgtattttctaccacaaaatgtgtagacagaataatacaacaaatctacatgtatacagcttcaacaattatcaacttataaacaatcttattttatttctgtcctcatctaacaccttgtctcttgattagttggaagcaattgatagagtttttgagctcttagagtgaaggggtggacccttaacatagctggaaatcatgggaaagctagtgacttgtgtgaatccagaagaaaagtggtactagtaagtggagtgatatgaagtctttataaggaaaatctagaaacaggaaatataataactttagagtatcattttggggtttccaagtatctaagaggcagattaaagaaatggaagtgagatagttttttgagaccagactttgttctgaaatcagacttaagatacaaatgtgcattttttactttgataattagagaatgaagatcttgtgtattctaaaaagttctctgtttttcctgtaatgttgattgcaggaggatagtccagggctgtgtggtttgttttataagtagctacttttatcaagaataattagcagagcatttgggaagagttttggcttttcttccctgaaatcaaaatataactatttagaaagcttttattgtcgcttataaatggaaggagtacttgtcacttccaaatgacaggaagaaccatagagcacttctacagtttgatttatatctcttaagtgtcatgttcctgtgcgggagctgtagtggttgacagcctggttcctagaactgagaggtgaagcccgctgagcttctggattgggtggggacttggagaacttttgtgtctagctaaagcattgtaaatgcaccaatcagtgccctgtgtctagctaaaggattgtaaacacactaatcagcactctgtaaaaatgtaccaatcagcactctgtaaaatggaccaatcagcgctctgtaaaatggaccaatcaagcaggacgtgggcggggacaaataagggaataaaagctggccgtaccagccagcagcagcaagcagcttgggtcccttccgcgctgtggaagctttgttcttggctcttctcagtaaaacttgctgctgctcactctttgggtctgcactacttttatgagctgtaacactcacctggagggtctgtggcttcattcctgaagtcagtgagaccgtgaacccaccgggaggatcaaacaattccggacgtgccaactttaagagctgtaacactccctgcgaaggtctgcggcttcactcctgaagtcagcgagaccacgaaccaaccagaatgaagaaaccccagacacatctgaacatctgaaggaacaaactccggacacactatctttttttttttttttttttttgaaatggagtctcgctctgtcacccaggctggagtgcggtggcgcgatctaggctcacggcaagctccgcctcccgggttcacaccattctcctgcttcagccttcccagtagctgggactacaggcgcccgccaccacgcacggctaattttttgtatttttagtagagacagggtttcaccgtgttagccaggatagtctcaatctcctgactttgtgatccaccctcctcggcctcccaaagtgctagaattacaggcgtgagctactgcgcctggtcaggacacaccatctttaagaagtgtaacactcaccgggagggtccgcgcttcatttttgaagtcagtgagaccaagaacccacgggaaggaataaattccggacacagaaccgtgactgggaccatgtgaagtggggacttcacatgatcccaataggagatcgcaccactgcactccagcctgtgtgtcagagtgagactctgtctcaaaaaaaaaaaaaaaaaaaaaaaaaaagaaagagattagatgccccttgccatgcagaaagttagggaaatagtgttctagttacaggaagcttttaggcagtgctgagcttgatgagttcaaagaatcaaaagaagtccagtgtgtggctggaacacactgaaggaggggaggggtgacaatgagattgtcaagttgagcacagaccagccttgtaaatcatgttaaagaatttaactttaagtgtttttgtaaataattgaaatattttaagctgggtaatgacatggtctgttttatgctttaaaaaagatggttcttttttgatttcagattggaaaggactaaaagagaagcaggacacgacttaagagggaagatattcgggctgggcgtggtggctcacgcctgtaattccagcactttgggaggctgaggcaggcggatcactcgaggtcaggagttcgagaccagcctggccatcgtggcgaaacaccgtctctactagaaatacaaaaattagccaggtgtggtggcacatgcctgtaatcccagccactctggaggctgaggtgggagaattgcttgaacccaggaggcagaggttgcagtgagccaagattgtgccattgcactccagcctgagtgacagagcgagacttcgtctcaaaaaaaaaaaaaaaaaaaagaaagagggtaagatatttagtgctcagaaccagtgctggcttgggttaaggtagcagcagcggcacaaggagtatgtagatgtgggaaatgtgtttgtgtttggagtaccaggacttagtggtgggaggtgaaagagaggcgttatgaatgacccctgggtttctagtatgagcaaactgatatgccacctctcgagggtgtgtgtgtgtgtgtgagaaaaagcatgtgagagagcatacatataagagtaattgagtctggaattcagaagactggcctgggatagagatacacatttggggggagttggcatgtagagagatttaaagcaataggaatgagtgagagagggagagagaagaaagagggcctagcactgtgatttcatttttctattgactctgttttttgaatttaattttagacattagaatagataaggttagctttccaaaatcagtctcatttgtattcggcattcagataaactcatatatttgcatatattattgttattattttttgatacagggtctcgctgtgttacccagactgcagtgcagttgcaccatcacagcttactgcagcctcaacttcctgggctcaagtgatcctttggcctcagcctccaagtagctgggactacaggcatgcgccaccatacctggctaatttttaaatttttgtagagacaaggtctcactatgttgcccaggctgatctcaaactcctgagctctagcaatcttcctgcctcagcctcccaaagtattaagattataggcgtgagccaccacgcctgaccagataaattttcagaatgggaaagggatggagttgcagctttctgggagggtaggggatgaaggagtagaggaggactcagggatttatgtggtctccagattacttcatttctggagtagtttacagtatgcccattatgaatgtgtctcatcctttatgtgtgtagtggagaaaaaaggttgagtttctgatcctcaaggtaaagtcgatattaatagttaactaaagtttcctacattctggcccctatctgcctgtctgcatatccacattcataccattcccttccaacctccatgcatgctgttttctatcatcatggtcctagacctagaatttcctttttcattggacaaatattttaggtctctgtttcagtcagagctttccctagttcccccaggcaaactctgtatttgtttctgtttctagtgttcattggttatagcaattattgtattaaatttgctgtttcttggtttgactgtctcctcaagaaactaatctttttgacatgagggattttttttttcttttaaaaaagcacttgagggccaggcatggtgggttttgcctgtaatcccagcactttgggaggatgacttgagcacaggagttcgaggctgccttgagccgtgattgtgccactgcactccagtctaggtgacagaatgagaccccatctctttagaaaaaaagtgtttcagtgtttgaattaccatcctgtctttctttgaagagccaaatacagcttacatcatcttcaggtaaaacaaaatttagggttcagaaactatatggcataagaaaatagttgaactgggcacagtgtttcatgcctgtaattccagcactttgggaggccaaggtgggcagattgcttgagctcaggagttctttcagaccagccagggcaacgtggcaagaccttatctctaccaaaaatacaaatagctggtcatggtatgtgcctgtggtcccagctgaggccggcaggattgcctgagccctggaggtcaaggctacagtgagccaaaactgtgccactgcactccagcctgggcaacagagtgagatcctgtctcaaaaaaataaataaataaaataaaataaaaaataaaaaagaaacaaaatggttgaaaatgtctttcccatgcctttggagtctaggatgaggtttaaaaaaaaatgtgtttctcaggtctattttaataggtagttaaaatatactttaaaaaattattataaggcagtctctaaagtgtattcttatccccaaagcttgatattacttaaaagaaagatgtattactgaaggaaatagaaattgaattaatggaattgttttggttatttgaattgccatttctgtagggtatttgagaattgttaggtcttgtttggaaccattgataaacagaagatagaatagaaatattgtactgcctcattgttcctagtctacaaattgatttatgctgttattcagtttatgtctctctttctctttttttttttttttgagatggagtttcgctcttgttgcccaggctggagtgcaatggcatgatcttggctcactccaaccttgacctcctgggttcaagcgattctcctgccttagcctctcgagtagctgggattacaggcatgtgccaccatggctaatttttttttttttttttaagtagagatggggtttctccatgttggtcaggctgatctcgaattcccgacctcaggtgatctgcctgcctggcctccgaaagtgctgggattacaggcatgagccaccacacctggcccagtttatgtcttttgtatgtacacagtaaaaagtagtagtctctttctttacatagtaaaaagtagcagtttcttactttttttttttgagacagagtctcgatctgtcgcccaggctgaagtgcaatggcactatctgggctcactgcgacctctgcctcctgggttcaagcagttctcctgcctcagcctcccaagtaactgggactacaggcacacgccaccacaccccagctaattttacatttttagtagagatggagtttcaccatgttggcaagggtggtcttgaactcctgacctcaagtgatctgcccaccttggcctcccaaagtgttaggattgcaggcgtgagccaccgcgcccagactaaaaagtagcagtttctatacccatcattattataatgttttactgcgttgatatgtatatagtggagcttttttgttagatttgaagaaaaaattggacgatgaattcattctaattaaaaaaataggccaggcacggtggctcacacctgtaatcccaccactttaggaggccaaggcaggcagatcacctgaggtcaggagttcgagaccagcctgaccaacatggtaaaaccccgtctctactaaaaatacaaaattagctgggcatggtggcaggtgcctataatcccagctacttgggaggctgaggcaggagaatggcttgagcctgggaagcagagattgcagtgagccaagaccgtgccattgcactccagcttgggcagcaagagcgaaactctgtcttaaaaaaaaaaggccgggcgcagtggctcatgcctataatcccagtactttgggaggctgaggcagggggatcacctgaggtcgggagttcaagaccagcctgaccaacatggagaaaccccgtctctaataaaaatacaaaattagccaggcgtggtgttgcatgcctgtaatcccagctactcgggagactgaggcaggagaatctcttgaacctgggaggcagaggttgtggtgagccaagatcgcaccattgcactccagcctgggcaacaagagtgaaactccgtctctaaataaacaaataaataacctaaattttaaaataaaaaaatctttgacactctacctttcagctgtcagtggaaaccacttaggtagctatgaagcaattctgcaaatattttatggaattctatatttgccagagtataatagaaaaaactaggccgggactgggcgtggtggctcgtgcctgtaatcccagcactttcggaggccgaggcgggtggatcgcctgaggtcaggagtttgagaccagcctgaccaacatggtgaaaccctgtctctactaaaaatacaaaaattagccaggggcttgtaatcccacctacctgggaggctgaggcaggagaatcacttaaacccaggaggtggaggttgcagtgagctgagatcacaccattgcactctagctcctgggcaagagagcgagactccatctcaaaaaaaaaaaaaaaaaaaaaaaaagaagtccgggtgtggtggctcacacctgtaatcccagcactttgggaggctgaggcaggtagttcagctgaggtcgggagttcgagactagcctgaccaacatggaaaaacctcgtctctcctaaaaatacaaaattagccaggcgtgttgtcgcatgcctgtaatcctagctacttgggaggctgaggcaggagaatcatttgaacccaggaggtggaggttgccgtgagccgagatcatgccattgcactccagcctgggcaacaaaaagaaaaacaaaaaaaaaagaaaaaaaactaggctgggctcagtggcttatgcctgtaattccagcactttgggaggctgaggcaggaagatcacttcagttcaggagtttgagatcagcttgggcaacatagcaagacctcatcctctacaaaaaataaaaaaaattaggtatgttggcatgtgcctgtggtcctagctactctgaaggctaaggcaggaggatctcttgagcctgggagatggaggctgcagtgagccatgatcataccactgcagtccagcctgggtgacagagtgagaccctgtctcacaaaagaaaaaaaaaaacaaaaactacttgagtcagcgagtacatagaacatttcagagcctcagcttgtatactgcatgttattctgaaactacagataccacgtagctttctaatgaaaaagttttatttgtttcttcctttcttttataggaatatatatgtcccagatgtgaatcaggctttattgaagaagtgacagatgattccaggtattgtacaagctcatgaataaatcagacattctattatcaaaactattttctctcagcatggactgagtaagttgaatttgttttacaacttacactctacagagagagcgagagtgagagagagagagtgagtgcatgagcttgcacaagagagggcagaagaatgggagaggaaaaagaaagaaaaatgggaaaatttggaaagtgatatcatagcagatgtggtgatacgcactgctcctgattgtatgtggcattccatgtacatctgtacgcatgtcagagtaaatctggtaagttttcatttattatctgagacttggggcttctcttagattattagttggtttttagtgaccactctgctgtctgaaggtaaactgctgttatacctctttggcgggttagggagtgacttctgacaaagatacctaatcaggtaaacaggctgttctagccaggaaaaccgattgttactctgctttgaggaggccttgaatctcttgttcttattaaggttatttggccagtgtggtggctcacgcctgtaatcccaacactttgggaggctgaggtgggtggatcacctgaggtcaggagctcaagaccagcgtggtcaacatggtgaaaccccgtctccattaaaaacacaaaaattagctgggtatagtggcgggcgcctgtaattccagttacttgggaggctgaggcaggagaatcacttgaaaccgggaggtggaggttgcagtgagccaagactccagcctgggcaacaagagtgaaactgtgtctcaaaaaaaagaaaaaagaaaagattattgctgtcaaacttaggccatctttccagggtgatattaatatatgggtttgtaatgcttggaatttgttcttattggccttcataaaggtatacagctgataaaaaggggaaatatttctgaaagtgactattacatattccttttttgtttatgtgaacaaaactataaaatcttttttcttttttcttttttttttgagacagagtcttgctctgttgccagattggagtgcagtggttcgatctcggctcactgcaacctctgcctcccaggttcaaatgattcttgggcctcagcttgcccagtagctgggactacaggtgtctgacactatgccctgctaatttttgtgtatttttagtagagatggggttttgccgtgttggccaggctggtcttgaactcctgacctcaagtgatccgcctgccttggcctcccaaagtgctgggattacaggcatgagccaccgtgcccaacctaaaatctttttcttttttttttttttttttgtgacggagtctcactcttttgcccaggctggagtgcaagggcacgatcttggctcactgcaatctctgcctcccaggttcaagtgattctcctgcctcagcctcccaagtagctgagattacaggcatgcaccaccacgcttggctaatttttgtattcttagtagagatggggtttcaccgtgtttgccaggctggtcttgaagtcctgacctcgtgatccgcccatcttggcctcccaaagtgttgggattacaagcgtgagccactgcacctggcctaacttaaaattttaataaattttagaatagcattgataggatggcctcttttggctaaacaaaatggcacatttgttcttttggggctatttggttaaacattcgtctgaaaattgaagaagtaccgactggtcaaaaagaatctgtaatctgaagcctcttaatcttggagtgactttggagattttaatggcagtaggtaattcctttactgttactgttggcagaatctaaagttgaaggtcccttccacaaccaggaaaaactacacattttacagtatgtactattagttttactttactaatgattggtgattatatgtgtaaataagctggagcttctggggcaatatgtggcatgggatctattttgatacagttaaatgtcatcttggttttaaatagtacaataccaacactaaacgtgtaagattagcatgactgcaaaattagcaattttgtgtggatggcatgctaacttgggatagctttttgtttgtgccattataattgcatcaaataacttatttcaggcacttatgctctgcatgtgctaattaaaagatatattggttgtgggagaacaattaatgggcttatcttttgccaacttttcaagtagtaaccctggtttctttaggcagatagtacttttatgcaaatacagttataaatgagaatgattaactgtaggatgaatctttgtctagcagggaactgtggattctgtggtttttgttcttaattcttttatgtgtctttgtagatcaaaggttgtcttatataggtgctattggtagcaatttactcaaatacaaagactctgtggtttgaaagagattagtgttttaaatgaaagaagaaatctttttcttagaatccttgtcttagaggcagtatgatatttccttctataaagttcataaacatttgctgatttaaatacttagcaattgcagtggtaagtagtggagggtaaaaaccagtaagaggagggccttgcatgtaaatattagataatgggctccatctgctcttaaacttccatgtagaggagcaccttgtaagttttcttaagctttgtaacatttctcagaacaatgtggtggtttttattatcccttctctatgattagctctattattctttaaaggaattttaaggaaagggaacggtgaggtagcttcagggagagcagaaccccagaaaataagagttgcggtttcaattaccaaggatgtttgaatccctgaaactgtgtagtaaaggcaggaaggaagagtcttggaagcctgtctgggcttgagcaatcaaatggatacatagccactcaatgtagttttttatggtatgtggtagttcaattagctgtttatttagcatagatgtacaagtacttttgggcttgttatacatttggagtgatttttacaaaagcgtttttctgaaattaatgcaggtattaaatggtttcttatcagggaataaggcttgagaatggttgcataaagagtggcattagctttgctttttcacttttggtttcagactaactagggtgtgtttgtttcctcagtgagctcagcacaatgcctggattggtattgtaatcctacaaatgaaaactatttgtagtagtttgtgaacttaccattggggtgagtgtttgtatgtttgtgtgcttaagtgtgtctcttgaagtaaaagtggtatccagcagttcctgtgattctttccatcccctcttcccggatgtgttaacttgttttctttgttctttgcaaatttcatggggacaatgggatttaatatttctctccactcttcagggtctttgggaatagatagttattttatcattttcacatgtgattaattcaacaacttttgagtgtcaatataggatattgacattgcaggattttaaaaggtgatagtactgtgtaatgtctgacacttaaacactctacatgtatttgaggcattaataaattgcagtctttgccttctgaatttatattaatgaaggagggaaatgggttgaaatggatgtggcaaatcctagatatttataatacaaggtaggttttagaatcaaagtgagagtgcagaagggtgtggaagagtcttatttggttggtgagttcagaagggcttgatggaggaggtagcatttgagatgggtcctgaaaggtgggtagggggagaaatatttattgaatccttttataatgttttaaatacagtaccaggccccttacattactacatttaatcattcctaagaaatattaactattgtagcctcaaatgttgtgttcatctggtggttgaatggttttttagtgaaacattttgttttgttagcgttcttgaggataaatatttgtcttttgataggtcaaatccgaattgcattgctgcctgtgggtcctccttccttctctatggtggcttctccaatttttcactggatttagccttgaaaaccacttgattttgtggtttatgatacttttcatagattaattcacatgccagttattcataatttcctttaataggtgttgtgttgggatgagttatttttccttattgggctttgttctcattatgccattctatatttagcttctgggaggggagcttgttcctgggaatagaatcaccactcattccttttctctttagttttttaggtggtggcggcagtcggatagacaataccacaacaacacattttgcagaggtaagttttcctttagctgtaggaattctttaagaagtggttaggtgttaaaatcatggcagatactaactttccagtgtggcacaacatcagagtttaactgaatgtataagaaaaaatgtgggccgtagtaacccttgggaagatttgtgttttcagtagctggggcttgggcgtgttacctttgataaacccttgattaggagaaagtaatagcctcaaactgtattcttttaaactggtagtgtttttaattcttgttttctactttgttattgtatatacagtgtgagaataagaagcttttgctgtttttgaaataacagtgttgcagactctgctttagtggtgtgacaaccaggtaaagtgcaggccaggataagttgtcgaagtcacaatgaaatagtcttcaaccttgtacagaggtactgatttccagggcttacctctagtcaacacagtagtttggtgtagattaaggatgtttacttgcctttcagatcccaagatggggtctgtaaataatttctatatcttcttataatgtggcgtccatattttttgggaaaaacaaatcttaactgtgatttgaaaacagggcattagtcttcattcttgaataccattttatattgaatccagagtaattttcttttttcacttcgtccattggcctaaagtctctttagttgtgttttttttttttaaaaaaagaaaccattgtaactgttcttaagtgtataattcagtggcattaatactctttgtttttaatcatttagagactacaacccagaaggtaccagtcagcctataaaaaacactgacgtttttcttttgcttgtttgtatgtgtaccctatattgccgtacaacttgttcagctctagaaagctgacagatgctaaaaggaagaaataagttaaatcccataatcaggatttctttatgttttaggatcacattagccttttccagagatagccgaagtgcctagagagatagcaaaatatttcactgttttgtatgtaaattgaaattgtactagtagtatatttgaaaagtgatatttaataagaagcctgtaaaaccctaagcttctctcccttattatttgaaaattattttaagacctgtagcccccacattttgatgttgttagatttatcaacattgtctgggtaatggtcctgttctatttagggtggtttttctgcttatggtctgtgctacttcttaatatacagtattaagagttttggttaactctgaactgcccgggttgattagagtgattccagacagatcgtgttttgaacttgcatttttattttcccattttaatggattgaaaaacattatttaatatgtgttctgggccaggcacagtggctcacgcctgtaatcgcaacactttgggaggccgaggtgagcagatcacctgaggtctggagttcgagaccagcctagccaacatggtgaaaccccatctctactaaaaatacaataaattagctgggcatggtggcatgagcctgtaatcctagctacatggtaggctgagacacgagaatcgcttgaacccgggaggcagaggttgaagtgagtcgagatcgcactactgcactccagcctgggtgacagagcgagactccatctcaaaaaagtaaaatacaataaaatgtattctgtttgccagtcctggaagcctttatgatttcagtattctttcctcttgtgtgtgctatttgtgataacacagattgtcacttactgattaggcatatgcagaagaagaaatttcatttgatttttctttagtgttctcttttaggtaatggaaatagatcggtctgccaattttgtaggtatgactcaccagaaagagatgcattgagtaagaagaaaaacaaatatatgtagtcagtttcctaactttagtaatgctaaatccaacactgatggcatgagttatccttcaggtgttaaagtatttttgctgattcatagcttgtaacttcgtgttctttagatgttgccagggatttttaataaattagctaagaagtgtgtgtgtgtgtgtttttaagagatggggccttattgcccaggctggactcgaacttctgagcttaagtgatcctcccacctcaggttccctagtagctgggattacaggcaggtgtcactgtgcctggctgaaagtatatactgaatgtttcatacatagcactctcctagaaataggggcaggaagtaaatgtcatggttgccttgcctgaaaggaacttaattttgttgtggagcaagtgcaaacacttaagaaaacaaggaaggctgggcgtggtggcttacgcttgtaatcccagcactttgggaggccgaggcaggtggatcacgggaggttgggagttcaagaccagcctggccaacatggtgaaaccccatctctactaaaaaatacaaaaaattagccaggcatggtggtgggcgcctgtaattccagctacttgggaggctgaggcaggagaattgcttgaacccagaaggcggaggttgcagtgagcggagattgcaccactggactccagcctgggcaataagagtgaaactcttatctccaaaaaaaaaaaaaaaaaggaaaagtgtacagagtataataaatttattctggggtatatgtaacaagtatagtagaaggaagagttaaggtgggccagggtcttgaggagaggtcatataacagtgattaagaacacagcctctggaaccagattgcctgagctcaaatcctgtgtctgccacttattggctgtgtaatctgggcaaagttacttagaatctctcagtgcctctcttgtccttgtctgtaaattgggaaataatcatccttccctcatagggatgttacgaggattaaatgagttaatacatgctaggtgtgtagaccgcaatgtgcctaccatctagtgagtgcttgatacattttagccattattaagacttcatagtgaagttagaacttgcactggagccttgaagagtaggtggaatttagataagcaaagatgtgaaaattatctcaaaatagtattcataagctataaggttttatgctcatgtccctgaagaaaaaacttagaaataaaattatatatagaaactaaagttgtttttcttttccctgctttagttggtaatttcggcaaagacttatgctcagttttgctctatttttctttagctggagctgcttgtacaatgaagtggttattttctataagtaacatttactgatagctgaattcttaaaatactgtctatattagaagaggcttattccaagaaaatttctgtcaaaatcagtattgacttttttttaaaaaaatgagactggggtaggagataagagactaatgggatagagagaaggtaggggagggttgccagttacatgggagcagtgtttgaataatgtgtgagggccggtggagagtgaatctgaaaatattgctagcagtttgtagagagaagacattgctatactaagcttcctggtggtaatctagaaagtgagccccatagctacctgaaggtttcattgattacttgcaaacttctgaccacgacctggtgccagtgggtcatctgatcttagagtctcagcttacctgaatggattgcttcagtgcaagagtggctctggctgctgcctcagattgggagaaaataagatacatggctttctggaaaaaagagctctcaggtatgcacaagagggcagggtgctctgagctgatttatatgtatttaaataaaatttgttatttgtttttgttacataagcagcattatagtggcagtaaaaaatttaaaaatatgtatcttgagtttcacttttttttttttttttttttttttagacggagtctcactctgttgcccaggctggggtgcagtggcgcaatctcggctcactgcaacctccgccttctgggttcaagcgattatcctgcctcagcctcctgagtagctgggaccacaggcgcgtgccaccacgcctggctaattttttatatttttagtagagacggggtttcaccgtgttagccaggatggtctcgatctcctgacctcgtgatctgcccgccttggtctcccaaagtgctgggattacaggtgtgagccactgcgcccggccgagtttcactattctaagagctcccttttccatacatttcctttcagattttgtcctaaggcatagttactgaaaaataacaaccttaagctcttttttgtttgtttttttgagacggggtctcgctctgttgcccaggctggagtgcaatggcacgatctcggcttactgcaacctctgcctcctgggttctagtgattctctcacctcagcctcccgagtagcttggattacaggcccccgccgccaaacctggctaatttttgtatttttggtagagatggggttttaccacgttggccaggctggtctggaactcctgacctcaggtcatcctctcgtcttggcctcccagagtgctgggattacgggcttgagtcaccgtgcctgggcctaagcttttttaaaaatgagaaatattggccgggcatgcagatcacttgaggtcaggagttccagaccagcctgtccaatgtgatgaaaccctgtctttactaaaaatacaaaaattagccgggtgtggtggcgggcacctgtaatcccagctattcgggaggctgaggcaggagaatcgcttgaacccaggaggcggaggttgcagtgggctgagattgtgccactgcactctagcctgagcaacagagcgagactccgtttcaaaaaataaagaaatatcccatattgtcattacttgattatagctttatgcattttttagcaaaatacttctcatttctcatgtgcatacctcataactgtttagagttgctgtcataagagtatattgtatttctgcctctaaaaatttacttggtattatgtcataaaccttttacttgtctctctatagttattagaattatagctggacgtggtggctcatgcctgtaatcctagcactttgggagggcggaggcaggcggattgtttgagcccaggagttcaagaccagcctgggcaacatggtaaaaccctgtgtctacaaaaataaaaataaaaagccaggtgtagtggcatatgtgtgtagtcccagctactcgagaagcggaggtgggagaatctcttgagcctgggaggcagaggttgcagtgagctgagctcgtgccactgcaccccagcctgggtgtcagagtgagaccctgtctccaaaaaaaaaaaaaaaattaggacttcatattctttaatggctacattatatttattaaactattatcctgtgttaggcatgtctagttatatatgatggttgatcatcgatcatacttcctttacctgagtctagaacatactgagaaaacatagaacaccagacagatggatataaaaatttaatttttattcagctgaattggaacacaaagttgaactgtggtcaaatggacatcctaagtttatacaggatgacctacctgagaattagaggctgcaaagcaggcacacataatcagaacaatgtactttgcatttgtgcaacttcctaatacatgaactccacttgctggagaaatgcgaaatcactagagattagactttgctattcactaatcagctacatcattcctctgttgaaaagtacatacaatatgatgccctttacataaaattctagaaaatgcaaaccacagaaagatcaggggttgcttggggatgggaaggggcaggagggaaggattacaaaggcacacgaggaaacatttcggggtgatgagtatcttccttactttgctttaatgttttcacaaaatcgcctgtgaactttttcaagattacatttctaaggttaataattataaaattatttacccttaattgactcatctttatacactctaatgttattttttgagatataattcatatactacgtaattcaccctgttaaagtgtacagctaagtggttttagtatattcacagagttatacaactattaccactgatttagaactttttcatcatccccaaaagaatccccatacacattagtagtcactacatatttctccacagttctctcagccctaggcaaccaccaatctattttctgtctctatggatttgcctatataggatatttgttataaatgaaatcatgcaatatgtgaacctttgtgactgactcttttctaattagaatactgttttcaaggttcatccatgctgtagcatgtatcagtacttcatttttatggctggataatactacatggtatggatattccacattttatttattcatcagttgatggacatttaggttgtttacactttttgcctgttatggataataatgctgctgtaaatatttttgtacaagtttttgtgtgatcatatgtttttaattttcttggttatataactaggagtgaaattgctgcgtcatatggtaactgttcaactcattgaggaacagaccataatattttaagaagtgctgatgtgatcatggttagtgtagagcaagttctgccaaatggaagatattgtccatcctgttttttattttgaatgtgtaaatagttcaccccaaatattttcagaaatactgtcattatacttacattcagagtaatgttttcagtttttcaaggcaaaacttgtcaaactgtctctgtgattctttagactgttttagcaaaactctatgatagtgttccctattagtttttacttatgtaagctgtgtcctgaatacccagttttgttgtatgagctattttttttttcttttatgcttatctaagtctactcagagacaaatgacctgaagctatttttatccttagtgctgatttggtataaatttgtgaggtgtgcttttccatcctgtgttctttggtcagggtacactattattttgagattaaaataggccacaaatacattgactgttactattaatttgcactaatttgcactttgtatactagtaggaaaatgcctcatgctgatgttgaagctgtttttaagcatggatcctttagaaattttgtatattattaggtgtggtaacaatttatagtcatctaaagtatgttagtatcaaagcagagtattatgaacttggtgcttgacttttctgccagtcaagattttaaatatttcatttttatattataatgaaactaatggttactttgagagttgtcttctgtgagcaaatgttgtggaattgtatatagtaagggaatcatagatttcttataattcaccttagtgagatagatgattgagaacatggaggagtctgctcgtactttttcacttattgaagacaagtatagttttaggtttttaaatgtcgtgtttactttggaattttgggtcaagagaattcttgtgttctagaccgtttttcagactagaaaccagtgatctctaatagatgaagactataattagaaagtaaagggaaataaggcagatttgataagaagcgcaaatggcagttaaaatgaaaaggtgttttatgtcaccagtatttagagaaatctttttgtttggagacagagtttcactcttgttgcccaggctggagtgcaatggcgcgatcttagatcactgcaacctctgcctcccgggttcaagcaattctcctgcctcagcttcccgagtagctgggattacaggcatgctccaccacgcccagctaactttttgtatttttagtagagacggggtttcaccatgctaggctggtcttgaactcctcacctcaggtgatccacccgcctcagcctcccagagtgctgggattacagatgtgagccactgtgcctggctgagaaatctaattgatgtttttactctgcatattactctttgttcttcagcttatatattagaatttttaaaactttaaaaaaatgttggtcaggctgggtgcagtggctaatgcctgtaattgcagcattctgggaggccgaggcaggtggatctcctgaggtcaggagttcaagaccagtctggccaacatggtgaaaccccatctctactgaaaataaaaaattagtcgggcatggtggcagacacctgtaatcccagctactctggaggctgaggcagcagaatggcttgaacctgggaggcggagtatgcggtgagccaggatggtgccactgcactccagcctgggtgacagagcgagactccttctcaaaaaaaaaaaaaaaaaaaatgttggtcagagtaggggtaaatgtaagcatttatactctggtaggagtctgaattggtacagtagcccccccccttaccctgtggtcaaccatggcctgaaaacaggtgagtatagtacaataagatattttattttatttatttttatttttatttttttgagacagggtcttgctctgttgcccaggctgaagtgccatggagtgatctcggctcactgcaacctctgcctcctgggtttgagtgattctcatgcctcagcctcctgagtagctgggactacaggcatatgccaccatgcccggctaattttttaatttttttagtagagacaaggtttcaccatgttggccaggctgatctcgaacttctggcctcagtgatcccccccaccgccttagcctctcaaagggctgggattataggcttgagctactgcgcccggttacaataagatattttaaagtggggcacagaggctcatggttcaatcccagtactttgggaggccgaggcaggaggattactttaagccagatgtttgagaccagccacaaaattagaccttatctctaaaaagaattttttttttaattagctgagtgtgatggtacatccctgtagtcctagctacttgggagattgaggtgggaggatcacttgagcctaggagattgaggctgcagtgaaccatgatcacggcgttgcactccagcctgagcgaccgagttgagaccttgtctcaaaaaaaaaaaaaaaaggccacattcacaaaacttttattattatatattgttataactgttctattttattattagttattgttgttaatttcttactatgtctaagttataaattaagttataagttataaattaaactttactgtaggtatgtgtgtataggaaaaaacatagcatataattagggttctgtatagctcactgtaaccttgacctcatgagcttgagctcaagatcctgggttcaagtgatcctccccactcagcctcccgagtagctggaacatcaggtgcttgctaccacacttagctaatgtttaaattttttgtagagacaggatctcactctgttgcccagactggtcttgaactcctgggctcaagcgatcctcctgccttggcctcccaaagtgctaggattacaggcataagccactgtgcccagcctgtttttgggttttctaggtacacaaattattaagagttcagcaaattttctgtatactaaggtcaatatacaaaaatcagttgcgtttctgttagcaggaattaactattaaaatatagaattttaaaaaaaagatactaaggcaattagaaagtcagttcaataggaaaatggacaaaagacatgaaacaagataagacataaaagagaaagaatagagatttaaaactgatttaattgaaacaactgatgagtactgaaaaagtaaactcagtgtgatttaacactgagtttaaatttaagaaataaatgtggctgggcgccatggctcacgcctgtaatcccagcactttgggaggccgaggtgggcggatcacttgaggtcaggagtttgagaccagcctggccaacatggtgaaaccccatctctactgcaaatataaaaaattagcggggcgtggtgtcacatgcctgtaatcccagcttctcgggaggctgaggcaggagaatggcttgaacccaggaggtggaggttgcagtgagccgagatcgtgccactgcaccccagcctgggcaacagagcaagactccatctcaaaaaggaaaaaaagaaaaaaaaagaaagaaatgtctggatttctaaaacaccaaaaaaaaaaaaaaaatgttgggggaaagagaagacatatgaatggctggtaaatattacatgacaagatgtttagccttattggtatattcgtatcagggaaagcaaactaaaaccacaatgacagggtgatgtcagcgaaaatggtagagtaggacttctgtgggtcatccctctgcagaaacaccaaacaccttgacagaaaagtcagaatttagcttatcaaaactctggaaaggtaatcaaaggtttacagcagccaagcaaatacttcgccagaagaaagggcactgaaacaaggtaagagatctttgtggcattttagcttaccctagcctcacctcccttcctggtatggctgcagtcttgaagatgacagcctgtgttccccatgctggtgcctgattccagagagtggacactcttcctcctgagggattctgtgttctgttttgtcctttctccaaaggactgccaccaggggcaaaaaacaaacaaaaaaaccaaaaaaagaaaaaaaaaaaaacagggcaaacaataagatattgaaagcctgagaggaaaagctgtagagtgagtttttgtagaggaataggagctttgaaaagctattgtggatgagaaactagaaagccaagtgcacagctcagggcagtatgtgtgctcagaaaagacctgagaaagccattagctttcacctctggcttgtctttaggttcaacacaaacaggaagtgaatattaaggtagatttataaaggccctgggtaagttttgaaggagtgccccaacagctaatcagtagagacctggcgagcattttacttttctttttctttcttttttttttctttttggtttatttgttttgaaatgtggtcttgccttgctcaggctaatcttgaactcgttggttcaagcgatccttccacttcagcttcctgagtagctggaattacaggcacacaccactgtacccatctatttttgtttttattttttacacattataaatgttcagtttttttaaaaaaaattacgaagcatgtgaagaatctagaaaatatgcttcattcacaagaaaaaagaaatgaacagaaactaccccgaggaagcactaatactagaattactagacaaaaactttaaatcagctgtcttaagtatactcaaagagctaaaggacaccatggacaaagaagtaaaggaattcaagataataatgtctcaacaaatagagaatatcaataaagagaaatttttaaaagtaggcaaagagaaattttggagctgaaggttacaataattgaaatgaaaattcactaggggagctcaacaaaagatatgagcagacagaagaatcagcaaacttggagataggtccactgaaattatatagtttgaagagcacacatttaaaagactgaagaaaaatgaacagagtccaggagatgtgtgggataccaacatatatatcatggtaaggagagggagaaaggtgcagaaaacatgtttaagaagtaattgccaaaaccatttcaaatttgacaagacatgaatatacacatcaagaagctcagctaacacccaagaaggataaactcaaagacatccatacaagacacattataattaaaatttccgaagccagagataaagagagaatcttggaagcagcaagagagaagcaacttgtaaaatataagggatcttaaataagatgaatttctgttgatttcttagcggaaaccatggaggctagaaggcagtgggataacatatttaaagtgatgaaagacagacctgccaaccaagaattctaaatctggcaaaactatccttcaggaattaagaagaaatcatgacatacccagataaacaatagctgagggggcttcattgttaatagacctgccctgtaagaaatgctaaaaggagtcttcaggctcaccacagatctattaaattttctttttggcataggaccgaaacatgcattttaattaaacattcgtaatttttcttacacagcaaaaccaaaagccccacaatggaaaatcattttctgttcactgattgttaaaaactttttttaaaaaaagtcctgtgacatcaagtgcttgccaggatgtggcacagtagaaactcttaaacacttggtgggtgtttaaattgctacaaccagtttggaaaacaatttgtcattacccagtaaagttgaagatgtatagatcatgtaatagttttacagaccaaaaatatagaaactctggtacctctgcagaagaagacatacagtaatattcacagtggccatttgtaatataaaaaactgtaaacaatccaggtgtttattgattgatttttctaacatgtgacttatttctggtctttactagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaagggtgagttgttttattttaagttctttttaaggtagtttcaatgaaggacaaattggtataatctaatctttataagggtctcatacttattacctttgtggacaagatggacatatgtagaaaggatgaaagtgaagctaaattgaatgttagtactcacccgatgataaaccagagagtgagaaatgctatgtctctgattaacatttttattaatggctcagattaatttatagatgatatgtgtctcagtccattttgtgcagctatagcagaatacctgagactgggtgatttataaagaacagagattcatttcttatatttctggaggctgggaagtccaaggttgagggatccacatctggcgagggccttcttgctgtgtcattccatgttggaaggcagaagggcaagagagcatgcatgagcaagaaagaaaggtgccaaactcatccttttattaggaactcactcaacaataactaatccacttccaggataaaggcatttaatccactcacaggagattcatctcttaaagtctccacctttcaacactgctccactggggattaagtttccaacacatgaatttttgaggagggcacattcaaactatagcagtatatttatcaaaatttcaaaagggtatcaaatatattaggcattaggattaaatatttcaacagattggaacagtggacttaacatgaaatttaatcaagtatctgctttttgtgaagaaaggaaaaaaatttaataggataaatatgaagtcttgtgactgtaaaaacattcatgtaataaatgtttgttgagtgtcttttgtatgggacactgtactagacactaggaacacaatgatgagtcaaatagatggttttgctcatggatctcatttagttggaataataaacgttaattttaagtgtttaccatatgcagaggactgtgcttcatgctttatctgctttatgttgtttaatttgtgtgaagtaataggtgctattgctgttttcattttataaaataattaactgagtctcagagaaataaagtaacagccattggtggatctaagacttgaatctagggctatatgaatctagtgcgacattgtcttatatggtagctgctagccacatgtagctatatgtttacatttaagttaaccaaaagttaataaaactcaaaattcaaagtacctcaatcccaaatagctatattttgagtgctcattggccacatgtagctaatacttatcatatttgacagaacatattatagaaaatttccattatcttagttctattgaacagtgctgttctagagcctacactccccctttcccccaacacacaccttctaggctttattaacattttactatacttgcgttattacatatctatccattagtgtttctttgttaaacttgtttgcttttggttcctaatatatgcactatcatactaagaaagtttaattttattcataatttattaggggcttttaattaagaatgactaatgattttgtcacatgccctttgcagtcctatcaaaatgaccttagagtttttctcccttaaacagttaatgcattttattaacaagtaggttttctaatgttttctagtgtttttattcaagctgctttgtcaaggagcactaaaacctcttttttaggggtcggggttggggaaacagggtctcactttgtttcccaggctagaatgcagtagcaagatcatgtttcactacaacctcaaactcggtgggctcaagcaatcctcccacttcagcctatgaactaggtaggactacaagcatgtgccaccacgcctggctaatttttcaatttttggtagagactaggttgcccaagctggagtctcttaacacattattggagttgatttgttccttatctttttttttttttttttttaaggatttttacatttattcaaaagaggatgagtctctttatcaagttttggtgtcaggattatattagtttcataaaaggaactgggaaaacttgctgtattcttatgcttggaaatagtttacataacacaggaattacctattatttaaaggtttaatgcaagttacctgtaattccatctggacctggtatctttttgggaactagatctattacagtcttttcagttacttctgtggttgatagtatagggtagtgttttatttatctctgtattctcagcttctagtgcagtatcggttttatagtggctactaaacatgtttgttttgaataagtggataattgtaattatgtctctaaaaagtataaaaaacatatgaattaatagtaataatagctaagagtatgtgccagaaactagtctaaatgctttacaggtattcatttgtttaatcctcactataaccatgtgaagaaggtattgtgaatatctccattttactggagaaactgaggcacagagagtttaggtaaattgtctaagagtataaaggcagttaaatattggagccaggatagtgcaaaaatcaaagtatttgtatttggtgagatttttaactgttcacttatactaaaaaattttagtataactatttagtataagtcaaaaatttaaaattaagtagccttctcacttattttttaaccaaagatttaagcatttccctaattttctcagaaactttccttccaaggcaccagtatatcagtaaatagaacttgaaagtttttaattcagtttcttttctcttttctttcatagaagtataaataaacacagtatatctttggggcctattactatacccagctagcaggcctgcctagattgttccatatggttgttactttacagtaattgtcattatgatgtcactgtatgttttgaaagtacaatttcatgttttatacatttttaaaaattgattgaattttagcatggcttcttcctgataacagttttgtcctcttgctttgagaaggagcatatgggcattccacttatggtttccatgggctgcatctcagattcctgttcattctacgggtttcactgtagacagagtactttgtatttaatggccgggtgcggtggctcacacctgtaatcagcactttgggaggccgaggcaggtggatcacttgaggtcaggagttccagatcagcctggccaacatgatgaaatcccatctctactaaaaatccaaaaattaaccaggcatggtggcggttgcctgttatcgcagctactcaggaagctgaggcaggagaatcacttgaacctgggaggtggaggttgcagtgagccgagattgcgccactgtactccagcctgggcgacagagcaagacctcatttcaagaaaaagagtactttggctggcgccaacagggtccaggtctgtgcctgccattggagaggatgccacagccacaggggtgggcgctggcctggaggcctccaaggggcatctcctgtgagcccaggggatgggcaggatctgagcggagaagagtgaaagtggaggagtgaggccagaacaaaggctttgccgtgaaagaggtggtttcccgcctaggctctgaccttcactcactgtgtggcccaggccaagggcaagcgtctgacctcgctgggcctttgtttctcaggggtaagatgaaacaatggctccctctccctctccctctccctctccccacggtctccctctccctctcttgccatggtctctctctgatgccgagccgaagctggactgtgctgctgccatctcggctcactgcaacctccctgcctgattctcctgcctcagcctgccgagtgcctgcgattgcgggcgcgcgccgccacgcctgactggtttttgtatttttatggtggagacggggtttcgctgtgttggccgggctggtctccagctgctaaccgcgagtgatccgccagcctcggcctcccgaggtgccgggatggcagacggagttgcgttcactcagtgctcaatggtgcccaggctggagtgcagtggcgtgatctcggctcgctacaacctccacctcccagctgcctgccttggccccccaaagtgccgagattgcagcctctgcccggccaccaccccttctgggaagtgaggagcgtctctgcctggccgcccatcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccaccccgtctgggatgtgaggagcgtctctgcccggccgccccgtctgggaagtgaggagaccctctgcctggcaactgccctgtctgagaagtgagaagctcctccgccgggcagccacaccgtctgagaagtgaggagcccctccgcccggcagccaccccgtctgggaagtgaggagcgtctccgcccggcagccaccccgtccgggaggtgaggagcccctccgcccggcagccgccctgtctgagaagtgaggagcccctctgccgggccagccgccccgtccgggaaggaggtgggggggtcagccccctgccctgccagccgccccgtccgggaggtgaggggcgcctctgcccggccacccctactgggaagtgaggagcccctctgcccggccagccaccccgaccgggagggaggtgggggggtcaggtcagccccccgcccggccagccgccccgtccgggaggtgaggggcgcctctgcctggccgcccctactgggaagtgaggagcccctctgcccggacagccgccccgtccgggagggaggtgggggggtcagccccccccggccagccaccctgtccgggaggtgaggggcgcctctgcccggccgcccctactgggaagtgaggagcccctctgcccggacagccgccccgtccgggagggaggtgggggggtcagccccccgcccggccagccgccccatccgggagggaggtgggggggtcagccccccgcccggccagccgccccgtccgggaggtgaggggcgcctctgcccggccgcccctactgggaagtgaggagcccctctgcccggccaccaccccgtctgggaggtgtactcaacagctcattgagaacaggccatgatgacaatggcggttttgtggaatagaaagcggggaaaggtgaggaaaagattgagaaatcagatggttgccgtgtctgtgtagaaagaggtagacatgggagacttttcattttgttctgtactaagaaaaattcttctgctttaggatcctgttgatctgtgaccttacccccaaccctgtgctctctgaaacatgtgctgtgtccactcagggttaaatggattaagggcggtgcaagatgtgctgtgttaaacagatgcttgaaggcagcatgcttgttaagagtcatcgccactccctaatttcaagtacccagggacacaaacactgcggaaggccgcagggtcctctgcctaggaaaaccagagacctttgttcacttatctgctgaccttccctccactattgtcctatgaccctgccaaatctccctctgcgagaaacacccaagaatgatcaattaaaaaaaaaaaaaagaaaaagagtactttgtatttgtatttaagaaatcagatgtcagagattagcctttgtgggattattagtgtgttcctcacaccaacttaataagtttccctgaaatgaggtccattttctttgactttttcattggcatgagtaaaacttttttactaacacagagacagggaactctcacattgttcattcattctgcaaatatttattcagtgtccctaaagtatgtgctttatcctctaatctgcagcttttgaatgatagttaattaggtcttgaatagactagctcatcttatctgactttaagtgcatctgacctgtgccagcagattaatttataaatttataactgagggtattctgtttcagtgactataaaactcatttgtttgttagcatactcttgtctttgaatttctcaagtatcaagaaatcaaaagcaatcagatggttgtttagtacatatagaatcagcaaggaaattgcatgatctttaagagaaattccatccagattgtgataaatgctaaggaattactcatatttcacttcaaataatttttttttaattttttttttttttattgatcattcttgggtgtttctcgcagagggggatttggcagggtcataggacaatagtggagggaaggtcagcagataagcaagtgaacaaaggtctctggttttcctaggcagagggccctgcggccttccacagtgtttgtgtccctgggtacttgagattagggagtggtgatgactcttaacaagcatgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaatttttcttagtacagaacaaaatgaagtctcccatgtctacttctttctacacagacacaacaacaatccgatttctctatcccttccccacctttcccccttctctgttccacaaaaccgccatcgtcatcatggcccgttctcaatgagctgttgggtacacctcctagacggggtggtggccgggcagaggggctcatcacttcccagaaggggcggccgggcagaggcaccccccacctcccggacggggcggctggccgggcggaggcaccccccatctccctcccggatggggcggctggctgggcgggggctggcccccacctccctcctggatggggcagctggccgggcgggggctgaccccccacctccctcccggaccgagtggctgctgggcagagacgctcctcacttcccagacggggcggctgccgggtggaggggctcctcacttcccagacggggcggctgccgggcggaggggatcctcacttctcagacggggcggctgccgggcggaggggctcctcacttctcagacggggcggctgccgggcggaggggctcctcacctcccagacggggtcgcggccgggcagaggcgctcctcacatcccagacagggcggtggggccgaggcgctccccacatctcagacgatgggcggccggcagagacgctcctcacttcctagatgggatggcggccgggcagagacgctcctcacttcccagacggggtgtcggccaggcagaggctgcaatctcagcactttaggaggccaaggcaggcggctgggaggtggaggttgtagcgagccgagatcaagccactgcactccagcctgggcaacattgagcactgagtgaacaagactccgtctgcaatcccggcacctcgggaggccgaggctggcggatcactcgcggttaggagctggagaccagcccggccaacacagcgaaacccagtctccaccaaaaaaatacgaaaaccagtcaggcgtggtggcgcgcgcctgcaatagcaggcacttggcaggctgaggcaggagaatcaggcagggaggttgcagtgagccgagatggcagcagtacagtccagcttcggctcggcatcagagggagaccatggaaagagagggagagggagaccatggggagagggagagggggagggggagggggagggccaaatatttttttaagacggtaaaatattaatgcttgttaggttttttcctttgtgttaggtcaacaccagcacattcatgttttccagacaagtaatagagattaccacccattagtctgcacttactacattaaaacccatctttattttattttgttgtttttgttttgttttgtttttttgagagggagtctcactctgtcacccaggctgcagtgcagtggtgtgatctcggctcactgcaacctctgcttcccaggttcaagcaattctcctgcctcagcctcccaagtagctgggactacaggcatgagccaccatgcctggaaaattttttgtatttttagtagagatggggttttgccatgttggccaggctggtctcgaactcctgatctcaagtgatctgcctgctttggcctcccaaggtgttgggattacaggcgtgagccactgcgcccagccccatttttattttattgtgctttactcttttgtttttttgttacactttagcttggtagtttagtctccttcctggttatataaaggaagcctctttgattttagcagtaagctgtttctgattcgctttgtagggtacattacttctaagaaggtgtcccacctaaataatacgttcttttaaaaatttattatttttattttagattcgggggtacgtgtacaggtttggtttttattttttaatttttaaaaatttgctttcctggtaactcacaaaacagcaggtttattacacgggtatattgtgtgatgctggggtttgggcttctaatgatcccatggcctaagcagtgaacatagtacctataggtagtttctcaacctttgcccttctccctccctctcccttttgtgatctccagtgtttattattccttactttgtgtccttgtgtacccaatgtttagttcccatgtataagtgagaacatgtggtatttctgttttctgtgttaagttgcttaggctaatgacctccagctatattcatgttgctgcaaaggacatgatttcgttcttttttatggctatgtaaagaatatgttttaagatttcccacctagagaatatgttcttctgaaattaaccctaggttcttggaccatagatttctgaccactgatcacatctcagattttgagaactgactttttttggttaacttttttttttcttattaaaaaaaatttgttttggtatggaataaaaagacagccttatccagaaatagccatagttacaccttgatgtataatcttgtagacctttttaaatacatatatatgataattacatctatataattgaaattgaattgattatactacacatattttataatcttttttatcttaatagattgtatatatctttcaagataacatttgattggggcctgtattagtctgttttcacactactgataaagacatacctgagactgggaagaaaaagaggtttaattggatttaatagttccacatggctgagaaggcctcagaatcatggtgggaggctaaggcacttctaacatggcagcagccaaaccatgtcattctgcccctggcccctccaaatctcatgtcttcacatttcaaaaccagtcatgcattcccagcagtcccccaaagtcttaattcatttaggcattaacccaaaagtctgaagtccaaagtctcatctgagataaggcaagtcccttctgcctgtgagcctgtaaaatcaaaagcaagctagttacttcctagatacaatggaggtacaggtatttcgtaaatacggccattccaaatgggagaaattggccagaacaaaggggttacaggtcccatgcatgtccaaaatccagcaggacagtcaaattttgaagctccaaaatcatctcctttgagtccaagtctcacatccaggtcatgctgatgcaaaaggtgggttcccgtggtcttgggcagctccacccctgtagctttgcggggtccaacctccctcccggctgctttcactggctggtgttgagtgtctgtggcttttccaggcgcattggtgcaagctgtcagtggatctaccattctgggatctggaagatggtggcccacttctcacagatccgctaggcagttccccagtagggactctgtgtgggggctcccaccccacattttccttccgcaccgccctagcagaggttctccatgagggctccgcccctgcagcaaacttttgcctgggcatccgggtgtttccatacatcttctgaaatctaggcggaggttcccaaacctcagttcttgtcttcagtgcactcgcaggctcagcaccacatggacgctgccaaggctttgggcttgcactctctgaagccacaacccaagctctatgttggcccctttcagccatggctggagcaactgggacacagggcaccaagtccctaggctgcacacagcacggggaccctgggcccagcccacaaaaccactttttcctcttgggtctctgggcctgtgatgggaggggctgctgtgaaggtctctaacagggcctggagacattttgcctgtggtcttggggattaacattaggctccttgctacttatgcaaatttctgcagctggcttgaatttcccctcaaaaaatgggtttttcttttttgtcacataggctacaaattttccaaatttttatgctctgcttcccttataaaactggttaacagcacccaagttacctcctgaatgctttgctgcttagaagtttcttccaccagatattctgaatcatctctctcaagttcaaagttccacaaatctgtagggcaggggcaaaatgctgccagtctctttgttaaaacataacaagagtcttctttgctccagttcccaacaagtttcttatctccatctgagaccacctcagcctggaccttattgtccatatcactattagcattttgggcaaagccattgaacaagtctctaggaagttccaaattttcccacattttcttgtcttcttctgagcccttcaaactgttccaacttctgcctgttccttagttccaaagtcaattccacatttttggtatctcttcagcaatgccccactcctggcaccaatttactatattagtccattttcacgctgctgataaagacatacccaagactgggaagaaaaagagctttaattggacttacagttccacatgactggggaggcctcttaatcatggtgggaggtgaaaggcacttcttacatggcggcggcaagagaaatgaggaagaagcaaaagcagaaacccctgataaacccatcagatctcatgagacttactgtcatgagaatagcatgggaaagatcggcctccatgattcaattacctcccccagggtccctctcacagcatgtgggaattctgggagatacaattcaagctgagatttgggtggagacacagccaaaccatatcagagcccatctaggggaggtttcttaattaattttttcctgggctcaagtgatcttcccatctcagcttcctaagcatctaggaccacaggtgtgcagcactaggcccagctaatttttaaattttttttgtagagatggggtctccttatgttgtccaggctagtcttgtattcctgtcttggcctcccaatgtgctgggattacaggtgtgagccactctgcctggccccataagaggtctcttaatttattcagcagacattgtgtattactgtgtgccagatgttgggcatacagtagtcaataaatagtcaagaatgactgccctcgtggagcttaagtactaatggagaaagatagatgatcaaaataaatagaattttaagcagtagtaagtgctatggtggaagaaaagcagggatgggagatagggaatatggttgaagtgaagtttcaaaaagagcatagtcagcaaatgtcttattgagaaagtatctgaatagacaccaaggaagtgtagggatggacaaacaaggagagaccaatgtagggcagagaaggtgaggggaatggtaggagaagttgatgggagtgggaatggggaggtgggtattagattatatgaagcctagttggcaattataagagcttctgttccaatggagagttaggtgtcatttatatcttgaaatgattgctctaactgctgtgctgaaaatagaatggggggctgcgaggtgtgcgaggcaaagacacagcagagaaaccatttaagaggctattgcattaatataagctagagatgccagtggtttgggtgagagcagtgaaaaatggtttggtttcagatgcagtttggcaatattcatgataggagttactgacagattggatgtggggtgtaacagaaagaagagttatgacaccaaggtttttggcctgaaaacaagaagaatggagccaccatccactgacatggggaacattaggaggagtaagtttggaggaaaatatttaagagttcattcagtttgggacataataagtttgaggtgcttattatacaagtggaaatgttgaataggcagaggtcttggctggagataatatttggaagttgtggcctatatatgatatttaaaattataaagctggataaagtggtcaaagaagtcaagataggaaatagcagagctcagagaattgaggcctgggccctcgatggttagaagtttggaagataaggaagaataagcaaaggagactgagaagaaacagccagggaagtacaaggaaaacctagagaggctacagctctggaaactatgtgaagactcttacctggttttagcatgtgacttcccttccagacccagtgggttgatttttctcgtctgtgagtttctaaaattaaatgtatacactatcttccttccctccacatcttccccagacatttagctttaacaagaaaagatttttttttaataaacaaaattcattgtaaatactctgtcaactattgttctccgagcaacagctcttatgcattggggccaccctcagcagtctctgttactgctacaaaaacatgggactaacatctgacttccagagagtaagtagccaagaaagagaaatcatcagctgatcagctgctggtgagttgtccctcgtaattccaagcattcatataggattgacttttacagcttcaagaactaggctatctctcaaacttgattattaccatttacttattggtcagtgtaagcataagataatttgcccttcttgtcactgacaaataggtgggtatatattagttacctattgctgtgtaacactttaccccagaatttaacagcttatgacaatatttattatctcaatatttttgagggtcaggaatttgggagcaatttagctagatggttctggtgaagggcttcatgaggttataatcaacatgtcagctgtggctacagtcaaccgaacacttaactggacctggaacatccacttccaagatggctcactcacatgactgttggcaggaggccttagttcctcaccatctgggcctctccatagggctccttgaatgtccatattacttggcagctagcttctcttggagttagtgatccaagagaatgatagaggaagcaggaaaaaaacccataatatctttttatatcctaattttggaagtcacacactgtcattcctgctacattttgtctgtaagaggtgaatcactaaatctagcctacattcaaggagaagagaattagctccacctctagagaatttatggatgtattttaaaatcaccacagtttgccctctagccacaaattatttacacttcttctatgtgcaaaatgcactcacttcctcccgaaatctatcaaaaaagtctccttcttctatagcatcagcttgaaatataggtagctgtccttttaactaggtccaagtgtgggtgtggctccttgggtatagttcctcaggtatagttccttttgttgtgaagacctgtaaactaaagagacaggttaactacctatcacacacccaacatacagtgatatggacaggcagtgattctgaacaggtatagagatttcctgttccaaaagggaaaatgatggcacaaagaagttgctggttcacagcaattctgatagttgtctagacaaatgtcagaagttccttgactaggacttctacttctgcccaggagttcttctctgtgactctggaatccaccctgttagtcatcctttcttttccattaaaagtagttcatatttgtagctgcatagctttcttagcttgcttcttgccagtagaaatttcagggcccagagaccggttttcattttgtactatttttccacctttcagtttaagctggcagtgtttctttttaaaacttcgagtatcctgtgaatctcactgggattcatgccattaggcaaaagccacatccaccaatctcttctaaataggctttttccaccttgggtttctgctgggattgctgagagataccacttgtaatgggtagaattgtgtcccccaaaaagctgtgttcaagtcctaaccctgataaggtcaccgtgaatatgaccttatttggaaatagggtcattacagatgtagtcaagttatagtaagatcacactggatcaggaagggccctaatccaacggttgatagtcttataaggagagaaatttggctgggtgcggtggcttactcctgtaatctcagcactttgggaggccaaggtgggaggatcacctgaggtcagaagttcgagaccagcctggccaatgtggtaaaaccccgtgtctactaaaaatacaaaaattagccaggcgtggtggcccatgcctgtaatcccagctactcaggaggccgaggcgtgagaattgcttaaacctggaggcagaggttgcagtgagctgagatcgcaccactgcactctggcctgggcgagagtgagactctgcctcaaaaaaaaaaaaaaaaaaaaaaaaaagaagctagaaatttggacatgaacacatgaacacagaagacagaagaaagccatgtgatgacagaggcagaggttgtggggggcatacatctacaaatcaaggaatggcaaagattgctgtcaaacatcaccagaagccagagagaatcatggaattgatctccctcagaacttcctgaaggaactaaccctactgacacccacatcagtgaacgaataaattccttttgttttaagctacccagtttgtggtagtttgttatagcagccctaggaaactaacataacacccttaagcttcttagtccgattttctaattgaatgattctttaggtaccattctagatctttgtgaggttgtgttttttttgtttttttttttgagacagtctcagtctgtcacccaggctggagtgcagtggtgcaatctcggctcagtgcaacgtccgtgtcctgggttcaagtgattctcatgtttcagcctcccgagcagctggcattacaggtgtgtgccaccatgcccggctaatttttgtatttttagtagagacaggtttctccatcttggccaggctggtctcaaattcctggcctcaagtgatcctcctgccttgacctcccaaagtgctgggattataggcgtgagctaccgtgcctggccctttctgaggtcttaacaaagaagtgttatagtctgatccttggcttcatctgaaatcagtcttttggcagtgccttggattcgatctttgcttgaaatctcttaattttagtgtcatttactaatctggagatgctgggaattctcagaattatataattctgtcctttttgtttaactgttcttcctttaattcatccctcttttgcattttaaagtaagcagcaagaagccaggaggtactttcaaaagtgaaatcactttagctagattatcaaccagtttttggaccacaacatctactttccatgttatggtaaggccacagctttgccattatataacaaggatccttttccctccagtttctaatcagattttttctgccttttcttaatctctcacctttaacttcctcaaaggccatagtgcttctgtttttttttaaggctcttcaaacttcactgatgctctcctcaaagtccttttaacttctgccccactgctgggttccaaagatactctcaagttttgggtctttattgtggcggcaccggtatccagatatcgaaatctgtatattatctattgccatataacaaattatctcagagcttagtggcttaaaacaacaaatatttattatctcacagattcactgggtcaggaacaggttcagttgggagtagcatggctgagtggttctggcccaggatttcatgagcttatagtcaagatgttggccattgctgcagtataggattgactaggctttacacatattctggcaggtttgttctggctgttggcagtactcagttcctcatcacatggacctttctataggactgcttgatatggcactctcccagagcaagtgattgatccgacagaagtacaaggagaaagcactgccccccgccccccacctttttttttttgaggcaaagtctctgtcacccaggctggagtgtaatggcacaatcttggctcactgcaacctcctcctcctgggttcaagtgattctcctgccttatcctcctgagtagctgagactataggcacgtgccactaatgcctggttaatttttgtatttttagtagagatggggtcatgttggccaggctggtctcgaactcctgacctcaagtgatccacccacctcagcctcccaaagttctgggattataggcaagagccaccacacccggccatttcccccacttttttttaccttgtcttggaagtcacagattatcaattctgccatattctattgttaagtgagtcactaagtccagcccacactgaagggaagattatcaaataatttttggacatatttttaaaacaacacgaagcattctaaaaaaaagaaaacacaatgaattcatagaagcagagaatagaatggtagttactaggagctgtggggcagagggggtggattagagagatgttgaaggatacaaaattttagttaaaagttcaagagatctgttgtacaacgtgggtgacagtagttaataacaatgttttcagccaggtggggtggctcatgcctataatcccagcactttgggaggccaaggcgggcggattacttgacagcccggccaacatggtgaaaccccatctctactaaaaatacaaaaattagccaggcgtggtggtgtgcatctgtaatcccagctacttgggaggctgaagcacaagaattgcttgaacctgggatatagaggttgcagtgagctgagatggtgcctctgcactccatcctaggtgacagagcaagacttcatctcaaaaaaagaaaaaaaaaaacaaccagtgttttgtacatctgaaaattgctgagagagtagattttaagggttattgttgcaaataagtttgtgaggtaatgcatatgttgatagtttgatgtagtcattccacaatgcatacatatttcaaaatatgttatataccataatatatgcaatttttgtcagttaaaaataaataatgaaaaataatacaaaaaagcaagcaaacaaacggaatagtgtagttagctgctgttgaactttagtagcagggaaagtctaatgttggctattgccattgttatattaattggcctaataagtaaagtgggaaccagggacttaaaattgcatatcattgctgggcgtggtggctcacacctgtaatcccagcactttgggaggctgaggtcaggaggtcaagatcagctttgtcaacatggtgaaaccccatctctactaaatctactaagtatacaaaaaattagccgggtgtggtggcaggtgcctataatcccagctactcgggaggctaaggcaggagaattgcctgaacctgggaggcagaggttgcagtgagccgagatcgctccactgcactccagcctgggcggcagagcgagactctgtctcaaaaaagaaaaaaaattgcatatcatccagaacacagaagatccagtgaaacaatttcttcaggtttttcttttgctgaggcatcactccagtatctctttgggtaacaaagactcattcgtgtaaagaactgtgtacctgtgccatcttaagtattcagagtgacaaatgctaagcatgtgtgtgtttatatgtgtttgtgttataatcatctgaaacaaccttaacatagaattattgcttaaacttttttttaaaggactctttaaatgatatcttattcagaaacccaatgtgtacaacatacaaaaatggaactacccttgttaaagggaggtgggtccagagttccactggctcggcatcccttttaacccttccttatgttgatgtcagatattcagggaacatagtttgaaaaactataccataccatcagatccctttccagcttaattcacaaaaatctattaatctgtaagatagcagagctcaggaagatagccataatagcaaaatagcacaccgctgtgtggcaggctgatttctgatgctgtctcttgtgtactagccaatgaaaagccattttggtttagggaattagttggtgattaggcagccatggatatctgtagagtacttttcattagtctgttgtcttatctaattttttcttctgtaacagaatactacaacacatctttgcaggattctttgcaaattctgccattcctggatctccacaccctttttcctggtaagtaactaattgttttctatcttactctattggagtgacatattttaggtgctgtcatttctgtgcagtagagaaaaagagctgcataggccgggtgcggtggctcatgcctctaatcccagcactttgggaggccgaggctggcggatcacgaggtcaggagatcgaggccatcctggctaacatggtgaaaccccgtctctactaaaaatataaaaaattagccaggcgtggtggcatgcttctgtagtcccagctactcggaggctgaggcaggagaatcacttgaacccgggaggtggaggttgcagtgagccgagatcgcgccactgtactccagcttgggcgacagaaagagaccctgtctcaaaaaaaaaaaaaaaaaaaaaaaaaaaaaaaaaagagctgcataggtgagtatgtagatgtaactggaggctgctacactgccattatctgctaagcccaaacttaatcagaacttttttttttattattattcaggctcaggaaggccgtcctggtcccccaggatgtttgggtgctagaaatgtcttgattccttttatattcaggtctgagagttgtattgaggtagagaatgagatggtccctgccaggcttggtatctgatttgtgggtttccccagtagactacacaggaatattttactccttaagaatttctgaaattgaaaacattatgctgaacttcatttttttcaaagtaagaggatttgtcagaagaaacaataggctgtaattcagtatcagagtgacacttatgtatgatgggattaaagatggaatttcttcttgtctgagaaattatttgctgcttctaactgtggcccagaaggtttctttgctcaaaggaacctcagtccttttaggacctctgtcatccagtagtctggacctctgctggtagtgtaccagcagctctgagggaaaataaaaaaaaacggtgttgccaagtcccttttataattgctctaagttgtgattcagagagactgctatggctgcttctctacttgaaagctcctcattgtccagaactgtgggcggcctcttataatgagggatgtttgctgtagattttgaccagtcatgaagggaaaactctccttaaaaagcagctccatctgtgtttaatatcagtgggcacagaaaacacaaatttttgaaaccaacaggcaatgagtcactctttttgttctggcgtgtcatgtggtactttaggtagcttcacattttatgttctagttaagtaaaattcttagagaatgaggtactatctctggatagtctgtttgatcttgaaaatgtacagaattctttgcctcttgatcctggaggactagtgactttccagctctgagagagaacaggatccctctgccaatttttttctgtggtgtaaggcagagcctggtcactccatctaatgctgtctatctcatctcacgtataggagcgggatgctgcactccaaccctggggactatgcctggggtcagacagggcttgatgccattgtaacccaggtgaggagctgccttttgagggtgtctgttcagtgtgtctcatggttccacaggcttcctgctttccttctgctactttctgaaatggcagtcactctgctttctctaatattttgagctttggggtttccattttactaaagggatgaatgatttatggggttagctcagcatccatgcacttcctaggtctgagggaatttctagaagatggtttcacctccataggaagaaaagacttctataacaaatagtattttgtatttttgtctctcttgctcagttctataaggattctattaacaaatatttcacaaaaaaaggagggtttcctcacatgttgaagcagggatttctgctagatggagcaaagtaggggaaggaagcagagaaaaaagtattcccatgccatgtataattgcttccacttgtttatgttcattttaatttgattggtttttcatttccgttgtggatttctgagactagaaagcatgtcctttatattcagtcgtcttataggcagtaatttacctatttcttggctcacgttatgctacttttcatactctcgcttttttcttcttccagaagatgaagcttttggaccagttacattttactttttattaagctatagttttactcgtgacaccacaacccttttgctgcctctgaagttgctttatgcctagaggtgggccttgcaatcatgggtttgtctgtaggcttatacgaacgtcactctgaaattgtaaagcaattatgagtgttctggcagcaggaaaggggaaacccaagcctctcagagccttgcagaagtaagagtaactaacatacctaatgtctgcactgtttgttctcagctggagcagttccctctccagggatattgcgatgtctgccacttcgtctttttctttctctttttttgtagcttttaggacaactggaaaacacaggccctcccccagctgacaaggaaaagatcacatctcttccaacagtgacagtaactcaggaacaagttggtaggttcatttttatacttattctgtcatcttctgatctcggttcaaaatcccggtatcttctgacaggtgaaaagtttaaaaagtgaacaaaataaaaagacaaaaaaataagaaaaaaaatcccaataccttcctatattaaggacctttaagtgaagctatagccctctaaaattcctatctgggtgccaaatctggaaagttcctacccctttattaggttagtcagttggtatttcctgagcaattatgtctcttttttaggtgccattgggaataaagaggtacaaagatagataagaattgattgtaacaagttgaagaaaaactgatcaaatgattaaaaactgtgttggacacatgatactgacattggggaaaggagaagaaaaaaataggctgggagtttgtttcaaatctactttgtgtcaggtacagttaggtatcttagtcatagatactattttatttgtaagcactggaggaatttagtgacaagggacagcattttggtctgggagtttctgttcccatcagttcgggtttagagttagagattttaaagacaaggtgggccatcttaggtcattctatttaaggaaaagtatgaactaatatacgtggtgtgtgagtcaggtaaagtggtctttagggaagattagtctaggggcagtgtgtgaaacattggaagtgagagagagcagaaacagggattttagagtgttgcagcagtccagatgaggttcagttgatggtgacaatgctaacagaaaggaaaggattcagaagatcattttggagaaatgctttcctcactcattgcataatgggatgaagaaggggaaagagtcaaagagaattctgagatttcacagctttgtaactataaacatggtgctgccatcttaagggacagggaaatagtgaatggaccctggtttgggtaaggagatgaggtgatgttttacattttttaatttgttgatttttgaggtgccagctgagaatccaagtgaagaggagctggggattgctgtggagctggtttgagggaaaactaagttgtagcaaagtataggatatatttggagggttaagaccgtggaatttgggatactagctgggaggctgttgcagcagactaggcatgagaagtaaaagaattagggctaaggtgataggaatggagagtaaggagtgaatctattaagtagtagtactgctccaaatgccttatctgctgttagttcatggagcatatcccagccactaggcgtatagactagctgacagtattagccaaatttgggaaactcaaaacttgctgcttggagctcccagtatagttcatgactgtttcttctcagagaagagggctttctgtctcttgatttcgtgacctgagctagacttcgactttgcagttctgcagcaccacttctggtatagcttttctggtatggcttctggtattttcttcttttctggtatagcttttattaataatttttttttttttttgagacagagtcttgctctgtcatccaggctggagtgcagtggcgcaatcttggctctctgcaacctccgcctcccgggttcaagcaattctctgcctcagcctcctgagtaggtgggtttacaggcgctcaccatcacacccagctaatctttgtatttttagtagagacagggtttttaccatcttggccaggctggtcttgaactcctgacctcgtgatccacccgccttcaccctcattaacagtttttacagaggactttaggacagccacactgaaataggatgcttcatcccatgctgaaaagagcatggtgaaagtggcaagtggcttgagacgctgcactgataagattgctgagatgaatcccttggctatggtggacagattcacagtagcaactgactgccagagggctgtcacacattgggaagatgtttttcctgttttactgagcagatcatctaagccccagtttatttcttccaactctttacatcaaaaaataggccttatatagttcctatataggcctttttggagtaggccccattcatcattccttcttttcatgtctctgtctactaccacctttaccctcattttgaaatacaagtcatgcctcttagctgcctgctacttgggtgtacattttcttttgtctcttgtgtcttttctttatgcattcgtagggttggtagagacattgggttagttttttcttctttccttttgcctgtttactttaaaaggcatttccttcttcaacagatatgggtttagagtgtccagtatgcaaagaagattacacagttgaagaggaagtccggcagttaccttgcaatcacttctttcacagcagttgtattgtgccgtggctagaactggtgagtacagcaagtcatggcttctttgggggatgattcagagtaaaggtatagttaacagttcctcgagatccaagtagatcagattttatcccataaatccctggcttactctgatactgttatttgtttggaacttttctgaccaagggttgcaaactatgttctacaggtcattgtgtcctgccacctgttattgtaaataaaattttattggaacacagctatgttcatttggttatagattgtggctacttttgtgctacgtcagcagagttgattagttgtaacagctgtggtgtggcctgcaaagcctaaaatacttattttctgtcccttatgtatttgttttgagacagagtctcactctgtcacccagactggagtgcagtggcgtgatctcagctcactgaaacctctacctcctggtttcaagtgattcttgtgtctcagtctccagagtagctaggattacaggcgtgcaccaccatgcccagccaatttttgtgtttttagtagagacagggtttcgccatgctgatctcaaactcctgacctcaggtgatccacctgcctcggcctcccaaagtattgggatcacaggtgtgagccactgcactcggccaattttcctgtccctttaaacaaaaagtttgctgacctctgctctagaccatattgggaagtaatgggcagttaccctcctgtcatagatcactcactgtttctggttcgttctgtttggtggtatgtattagctgttattaacttgctggcctagaattattcctgtcagttctgcttaaagttctgtttgggagatatcctggtatcacaccttagagccagtgcatgctctatgaggatgcattctctattgtttttctgttccatgtcataatttttgatgtgacaattctcagggttatttaagtgtacaatactcccagcttctcaggccaggatcttcacatagactaatatttttctgtttcagcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaactactcttgatcacattagctatgaggcgaggtcaaattcaggtatctaagactaatgattttgttttgtcttgatccccagagagcaaatcaaagaaaaattacagcaagaagagaaaagtggtttatcattgtgtgctttggttttcttattttaattttttttgttttttttttttgagatggagtctcgctctgtcgcctaggctggagtgcagtggcacgatcttggctcattgcaaactctgcctcctgagttcaagcgattctcctacctcagcctccagagtagctgggaccacaggcatttgttaccatgcccagctaattttttgtatatttagtagagatggggtttcaccgtgttagccaggatggtctcaatctcctgaccttgtgctccgcctgcctcagcctcccaaagtgctgggattacaggcgtgagccactgcgcctggcctcttattttaatttttaaagactacttcagttgatgcagtttcccaagaaacctacataacatatattgggagccttatgttgataggaatctgattcccattcctttttgggaatgagttgggcagcatacaggcacagaaagacagatgtttgagacctttgcttctgagattttaaaaaatgattaccgctgggcgcggtggctcacgcctgtaatcccagcactttgggaggccgaggcaggcggatcacaaggtcaagagatcaagaccagcctggccaacaaggtaaaaccttgtctctactaaaaatataaaattagctgggcctggtggtgcatgcctgtaatcccagctactcatgaggctgaggtgggagaatcgcttgaacccaggaggtggaggttgcggtgagccggatcataccaatgcactccagtctgggcaacaagagcgaaactccatctcaaaaaaaaaaaaaaaatccccaactcactgctttttttgtttgtttctgtcgcctaggctggagtgcagtggcacgatctcagctcaccacagcctcgacctcccaggctcaagtgatcctcccacctcagcctaccaagtggctgggactacaggcgtgtgccaccatgcctgggtaatttttgtatttttgtagagatagggttttgccgtgttgcccaggctggtctcaaactcctgggctcaagtgatctgcctgcctcaacctctcaaagtgctcaactcattgtttactgtcttttttcctagtaatcttaaaataatttgcctcacagaaatagagacagtaagtgtctgcagccagttcactgtttttggtaattcattggtcttcaggagttaagattttacattgtcacattttaatttttaagcctatttttcatctctgaaactttccttttctccttggttctggctatacttggactcaaactgatcagtgtgatcatgtccaaaacagcttggcctggaagaggtaggccttattttttcagcctagtagtgtcccatgcacatgctctttgtagcattcaagtgtttaacattggataaattaagaaggtcaagaatgttgttgaaacttcaaggtctcaaaaggaaatgatggggacatagaacaactgttggtgtaccaaaaaaaggtacagaggggcaccatttgtattgtcacacaacaatgatcagaatgatcagtttagaatgatcagaacaaaaacaccactctttaatgggtctttttcttggctagaagtctttcctcagtttttgttgactatcatacgctgatttgtgggtgacggaagggggctagagataacgtttctctgtactttggtaaaggatgaaggagtcagagagggaacagaaaaagtgagagagtggcctgctgaaataatagcctgcctctaaaagttgtgaccagaaagtatgattcatttgggcccagagggaataaaatatgttttttcatatacctcccatattacacctctgtagtgattgtttatttggggaatgagatctacttactgtgcgttgcccctgaaatgtagcttgagaatacacactggttttgaattggggaggaggatggaaggaaattagaggtgtattatgaatatttggccactacttagatggaggaaggctatgttgaacttgggacacattgcagttttcaagtacacaatatcagttgtctcagaaaaatcatgacagcctggacatatttgcttgtcagtgtctggagatgccaggacaggcagttgtagttttacgtacagatagagaaccaatgcctagagaactagaaaggatctgagtagctttaaaaagggtggaaacaaagtactggataggggtctgcctttttatacacagtatagcaaacagcatcagacaaagttacatgaagttttcttcactttttttgctctgatggatagaggatgtgagactcattttactgtttcccagacctgtcccacttaatggatctgttgtgtttcttcttataatggcaggcacctcagatgtccaggttaatttatgttgaggagttaggattcttcagggatttattattattattattattatttatttatttatttatttatttatttattttttgagatggaggcttgctctgtcgcctaggctggagtgcagtggcgcaatctcagctcactgcaacctccacctcctgggttccagcgattcttctgccttagcctcccaagcagctgggattacaggcacctgccaccatgcccagctaattttttatatgtttagtagagacaaggttttaccttgttggccaggctggtcttgaactctagacctcaggtgatctgccagtcgtggcctcccaaagtgctgggattacagacgggagccaccatgcccagcctgagatttattataaggaattggttcacacaataatggagtttgagaaatcccaagatctgcagtgggccagctagagatccaggagagctgatggtgtagttccagtctgaaggccagcttggataccctagaagagctgatgtttctgttccagttcagaggcaggaaaagactgaggtcttagttcaagcagtcaggcaggaggacttctcccttacttgttctattcagaccttcaactgattggatgagggccacttacattagggagggccatgtgctgtattcagtctactgactgaaatgttagtctcttccaaaaacaccctcacagacacacccagaatactgtatgaccaaatatctgggcatcatgtggcctagtcaagttgacacataagattaaccatcacaatgaggaaaaacagaaatgatacatgtatacagagtgctcctcatcccaattaagtttcaccaagttaataatgtgtctctatgagaagtggttcaccatgttggtcaggctgttttcaaactcctgacctcaggtgaccacccgcctcggcctcccaaagtgctgggattacaggtgtgagctagcactcccagccgacaggtgcttcttaaatgttttctttgagcaggaattggtccaggaattggttctcaagttagaaggaaaatttgaggggaagaacttgttttttctccaatcagtctctgattaaatagttattaggaaaaactccttgcttatgtctttgtattgcacatttttatatatgtatatatgtgtaaatagagatatttatatattcacagacaaacacgtgtatgcacatttcacaatggaggaagaagggatatggtgtgcactgaggtaaagtgagcagggatacagaagagagctggagcctcacagtctgattctctcattgtacataacctttagggtctttgtttccctgagttctctggtatggggcactgttggcttgggctggtaccctgttattctctgtgatgaagggattcactggaggtaaaaacgtaatcatttccaaaggttgagaataaatgactttgaggaaagggtgttcattatccgttgcttctatattataatcagttgaactacaatacggttatctattgattttttttaatttttctgacaaattattgacaccaaattgaataattcatgacctgcatgcttcagcttctttctccctggtttccaggtgctattccctcaagaaatgcaaattaaatatgtcggtcttaataaatcaggagggaagcatagtctgtgtctgttttaaatgacaacaacaacaaaacagctttggggtttaagaagtggaagacacatttttatttttttgagacacaatctcactctttcgcccaggctggagtgcagtggcgtgatctcaggtcactgcaacctcccgctcctgggttcaagcgattctcttgcctcagcctcccaagtagctgggattacaggcacgtgccaccatgcccagctaatttttgtatttttagtagagatggggttttgccatgttgcccaggctggtctcgaactcctgatgtcaagtgatcaccgacctcagcatcccaaagtgctgggattacaggcattagccaccacgcccaggtgagaagacagattttaagagaaggagcagggctggtatctgaataggtatttggatgttaggggaaaaccctttttggcctctgtggtagagcgatcggaaggtaaaagtgctgtttacaagaataatccattggagatctggggattggggacgacttataggatagagtcctcttgttgagaatttcccgaatgaatctcatgtaggttctgtcacagtaagatggaggaaaactttgatggggtaagtatcacaagtggctgtcctatagggggaaatcctagcctgcagtaatgtcagtgtctcagtattcagccagcgagccactgagctgctccaggggtttaaaatagaatgcatagaatacaatgtatacagctggtgatgctttccaggatcaaaatagagcccttgtctgatcccattgacattgtaaggtttcgatctctcatacctgccacagacaagtacattgtaggcattcaacttttaaggttttatacatgcaaactttatgttttcctgccacactacacttggtgtccacagaagtgtagtttgtatgttgcctcttcttcctctttcaaccagaacacttagatctgtgatcataggatgtaagcctgtgattctttactttttctaataagaaatacaattttcaagatccaaaaattattagattcttggctgggcattgtggctcatgcctgtaatctcagcattttggaaggctgaggcaggcagatcacttgaggtcaggagtttgagaccagcctgggcagcacaataaaacaccatgtctactaaaaatacaaaaattagccaggtgtggtggcatgcacctgtagtcccagctacttgggaggctgaggagggagaatcgtttgaaccaaggaggcagaggttgtagtgagccaagattgtgccactgcactccagggcaacagagagagaccctgtctcaaaacaaaaacccccaaattattagattcccttccaacaacttgatagccatattattagtatttttgattaaagaatacataacaaaaagctgctatgatttcagtaatgcttttaagttaatttattagtcacaccagaatctacatccaattgaaatatatacaaatatttgaaagatatttattcaggctgaagattatggtatatagattccttctgataacctcatggcctcacaggttcaaaacccgtgtttgtgaatcactcatacagattggggctaagatgcgtgtccagaaaaccacctattatgcatgaaaatttgtaggcttatttgaaggcaattgtatcaacacattttgaaagccaagacacaagtattttaagtttctgtttaaccaagtctcgagataagcagagtaaataaactctttagaagcaagactcagttggtatgtacaaagtgggattgctttgtatatattccgcttagtttgagtcagagctagtaatctgatgctcttaaatgtcttcataaacttgggcagtgatgtttcctttctgtgattatgtgtcacagatttttatatgtggactataattagtatagtacaatggctgaaacttttcctatagttggatatatcttctgagacttccagtgattgtataatgttgagtagctccagaagattatttgaatagtaaaaacaaaagacatctctacctatgtgagtttattatttagttagaaacacagaactaactatttaaaacaggtagagaaagattaagatgaatgtgatgtagtggagaaagctttggagactttggagtcagaactcaaatggctctaggtcccaaatccagactctcattttgattctcagaacaattctgtggaaagagaagatacaataggcaatatccctttttacagataggtaaacagaaatagcatctcaaaacctcatttgcactgggtgaggtggctcacgcctgtaatcccagcactttgggaggctgaggcgggtggatcacttgaggtcaggagtttgagaccagcctggccaacatggtgaaaccccgtctctaccaaaaacacaaaaattagccaggcatggtggtgcatgcctgtaatcccagctacttgggagactgaggcaggagaattgcttgaacccgggaggtggaggttgcagtgagctgagatcatgccactgcactccagcctgggcaacagagtgagactccgtctcaaaaaaaaaaaaaaaaattcatttgcccaatgacaaatagctggtatgttgcagagccagaatttgaatccaggtctttttgcctccatggctagtccttttatctccatgggatacagtctaaaatccttagtttgaggttcaagactatcactaataagagtcttactcatctacttcagccatatctctttccgttcccacaaaccttagctcccacatttggcaggtccttgccaaggagcacaggtaaagtgtctctttccttttaatggctcaccatggagctgtagctaaatttctgtgctcttacccctttattcatgtagttcctcctatcaggaatatcctgcccactctctgcttaactatgacaagaggtcatctgtccaaagagaaagaagagagtttgtggatttaggagaaaagaaaatactccaaatactgctatgggcatttatttaaaaagagaaatgaccaaagaggttaacaagtatttagatgaagctgggcagttgtagtctgtggtgctcttggtctgcacaaatcttcctcttcctccagcagtgctgtatggatgttgttgaatgttgaggtctgtctgcattttctcattttcatgccaagtcaatcactggatctggctgtcttcctttctgtcctacctatctttgcttgttttctctctctttcctttgcagtgttaaataaaaatttattcccccaaaatttggtgttctcattttgtttgacttattttactatgttgatgaagagggaggaaaagtttttctggggtacaaaaacgcatatatttatccgatatttgaggactatactacccactttggtgaaagctgttctgtttatttactggagcttaggagggaagaaggcaagtttgccctgatggtgaggagcaaagtcaaggattacactgatttgccccagcttatatttccacagattcttggtatatttagcatctcttcccctgtgccctgttgcattcttctctgtgcctattgtaatgagaaagatactaagccatagtcagactcatcttgctgtagctgttttaaaagtttcttttggcacaaggcttacaaagctgtggaaagaaagtttgtattactgccttataacttagaatagcaacaaaatacctgatataatgaagtctcacctgtcctgagatgcgtgcgtgataggccctcatgactgtaaagggattggaaaaggaaagtgggaactattttatgtattgcatcttattactaaattagggttgtaatcttgagcaaatctgattctggtgggagtgggaagggggctagcctttgatcgctccttgctggaaggaacaatcaaagaagcaatagatgccactcaaaaagttgaaggtaggttttccacgtatagctctgaattgttggcacagtggtaagacaaggatattcactgaaactagttcatgagctgagagaggcacagaggtccaggaaactccctcctccttttccccacatgtaagcatgataacttgacctatgtggtgtttctggacctgaaaaagcatgtgtactattctactgaatactacctctttcaataattctactaagccttgagttggggaagaaggataaagaaaagaaagcttctaagtagtgtatattttctcgtttaatcaaatattgagctttggttttttcctttggttaactttaaagctacttgaattgaatataggagaaaacaaaaaattggattcaaaagctcattctcttcacctgagtggaaaaggaaaaaaaggccagagatgattttttttttttttttttttgctctaggatgacttgggaatcaaagatagtaactagtagtaggttgtatggctagactcaatttcccctttataatttttattctaaaataaaatttattttactggttacagtggcctaaccaagggaatttaaagtcaacaaaaaattatgtctaaaggtcagactgtttcatattcatgtttcctcctgaaaactggcataggcttaaatttggaagatccttaccaaggattacagataaggtctctgttttctttttgaaatctctgttttcttttgatgacttgcaaataagggactggaatagggaatgtttaggtggtcctgtttctggaaaggggaggagtcaatctcagaatgaatggggtggtgaaggatgtaagaggtgctttgcatatagtagatcattactgagtgtaaggttttagagtgagaaggatctgtattaattgctgtgacaggcaacaattaactctttttttttttttttttcctttgagaaagtgtctcaccctgtcacccaggctggagtacagtggcatgatcatggctcactgcaacctcaaccagcctgggctcaggtgatcctcatgccttagcttgggactacagttgtgtgccaccatgcctaatttttgtatttttttgtatagttggggttttgccatgttgcccagactggcctcaaactcctaggctcaaaggatctgcctgccttggcctcccaaagtgctgggattacaggcgtgagccaccgcaccaggccctatttaacttccttgtgtctgtttcctgatgagtaaccaggggatgtttgcttgcaagggttgtataaggttagaatcatcatgtgtaaagcatctgattcatcatacaggttttttaacaaatttattaagagcctgccatatgtgtgggacttttcgttggggtaaagaagacaaagtccttacatatatatagagcttacattctgatgccattcaaaacagtggtagttattgatttgaggaatgcctaaataaaatggagttaagaatgccaaggccaggcaaaaacctgaatcagttgcttgttatgcaaaaacgttatgacaaattattggaagtttcactttttgttatctaatagggaaaacgctaatctatattggtaaatggttttcagaggactcagctacatgtgtttaatatactcaatctggccatcagcctttgctgaggagccgcattgttcaaaacccatctccaaaccaagtctgtctcttgccttttcttcctctaatagctgaaaatctgttgcttcaacttgtagccctctgttcatgcagtgagtagaggtagttgtactaacttgcctctctcacaggccttcattcctaatgagtcttacctcctacccattgaaaagtctgatttatctgtcttcctccttagtgcctttggatcagtgaaactggtttgaactttcctgtggatagccagggcttgagtaacatttttctctccccctggacatcctttccaaccttctcctcctggagaataaccaaggtggcagaaatataatagcaccctcattgcttggggtgcttacggctcttttggacataccttgaagggccacaaggctggtgaccagcattacccagaccttttcttgtaggaagcctgaactgagagtgccttcattatggctgaactcaaggtgttgtctttgtttcaatcccgtcactgtgtagttccctgtctctggttcaaaagagaatcatggatcaggggagggtttcagaaatcatcagtatctccttttgcatcatctcataacatctcttttatgatctccaaggattcctccctctgtaattcgttgcccaaataagtatttttaacattgtgggtaatgatgatgtacttaggcagccataaataagtatagaatctcctgtgtgtcagacactagggatgcagatagatcttaaagtaattctaaagttttgccacagagatagctgaaacagcttagtcgccttggacttgggtatccccaaatagccccattttctagagtggttcaagcaatctagcataagttaaaatcttgcccttttggaatagatctgggttttttttgtttgtttgtttgttttgtttttgtttttttgagacagggtcttgctctgtcatccaggctagagtacagtggcatgatcatgggtcactgcagcctcatgccccgagcccaatcgatcctcccacctcagcttccctagtagctgggactacaggcatgtgccaccacgcccagccaatttttgtattttttgtagagacaggttttcactgtgttgcccaggctggtctcgaactcctgggttcaagtgatgcacctgccttggcctccctaagtgctggggttacaggcatgagacactgcacctggactagatctggatttttatccatcatttactgttggatgaacataaattatcttcaagcttgagttatcacaggacaatagctcaaaagaccatggagattaaataatataatatcacttagcacaatgcctggcccacagtaagcactcagtaaatggcagacattgttttttattttattttattatttctttttttgagacagagtctggctctgtcgcccaggctcgagtgcagtggcgcaatctcggctcactgcaacctctgcttcccgggttcaagtgattctcctgcctcagcctcccaagtagctgggattacaggtgcgtgctaccacactcggctattttttgtatttttagtagagacagggtttcaccatgttggccaggcttgtctcgaactcctgatctcaaatgatctgccagcctcagcctcctgaagtgctgggattacaggcgtgagccaccacccaccctgacattgtttattacctgtctcttcttaactagttttaccttccaaaatgcacctaatttccacacttggggaaccatctagatgtgctgactctaatacttaaatatgctgagaagatgagaaaagcattcttccttagggagaatcttcacaactaaaacaatatattaggagaacaggatttaggttataaggagcaaggactgtgttatacctcattctgttctccaaggcatagcgctgggcctgggatgcacaatacatatttgttagatgaatgaaagaggagtatccactagtgcagtttaactgaagcaatgtattcacataaatagaatgaaatgctatagagtctctagtgccaggctaatgtaatttagactttattccatagacagtgagaagccattaaaactttgagtgatgtggcatgtacaaattagcattttggaaagacaagctggtggtagtatgtagaatggattggaggcagaaacagtatttagagttgctggaccattaggcaacagctcagtgctaggccctgtggtaggtgtgggagatacaaaggtgactagggcacagttgctgaactcaagggactcactagttaggagactataggaatatgttaagtgtgaggtgatgaagacctgaaaaacacctttggaaggaaaggaataacaaagtactgctattcttccccactaagtactgctgtgcggaagaacagcagtacttagtaactctctgaattgggggttaagaaaaaaggaggaaccaaagttgactccgtcatgaacagaaatagggtctcaggaggatagctttgatactgagtttgaggaaatggtgggacatccaggagctaggagtacagtttttagtttaaacgtttaattaaaacttaggaaaggtgttcaagctggagaagttgatttgctggtcagttgcagggagatgctggtttaaatcgtgggtagatgagaactagggagagagagtaaagagaaaaggttgaaggggtgagaagtgagtcttggggaatactcatgtttgagaggtgggaggaggaaatagagaagacaaaagaacagccaggtgggtagaacagccaggggagtacagtcacagaagccactggagatgacagtttgatgaaggagggaatagtcagaagtgctgaatgctatagctaggtcagacaggaagacaccaggaagcaaggaacaaagtcagtcaaactaaacaagttgaaaatttgaattaactaggaaccataggaggtgattagaaacatttgttcaaaggctctgggccagtttttcatggggggagggtggtgagtgggtaatttatacttgtttttcttaaaaagtaagataggccaggcacggtggctcacacctgtaatcccagcactttggctaggctgaggcggatagatcacctgaggtcaggagtttgagaccagcctggccgtcatggcaaaaccccgtctcaactaaaaatacaaaaaaaattagttggatgggtggtggcgtgtgcctgtagtcccagctatttgggcggctgaggcaggagaatcacttgaaccttggaggtggaggttgcagtgagcagagatcacgccactgctctccagcccggaccacagagtgagagtctgtctcaaaaaatcaaagaaaaagaaaaaaaaaagtaagatagttgtaagttcatggagaagtaagatagttgtaaaagttcatagagaataatagcagtgcccttttgtcctcctaggcttattgtctgagacaaccactgtcaactcttcgagatgtcttattatattcctaaataatatgctcatattgctgcttcctagtgataaaatttagacattttctattggctttctgctacagtagatgaagatgtgctagaatatagtagatgaggattatactttcacccattttccttctctgcattcttctaaaaataattgtaccacaaattttatttaaattagtcatgtttacataatttggattctgtgttattttttgcaaaatcaagttgtgcgctatgtttcttttgtaaaatttagttttttctagagcctgattttatttttttactggcagagttttccatatccatttctttaatctttttattgggtctttaatgggcctttagaaagatgatatgtcgattccatttttacctcctagagatctcccttccagagtcgtctttctcttgctctcttctggactaactgcccttttttaattctagaatttccttttttttttcttttccactagagatggtgtctccctgtgttgcccaggcttatctctaactcctgggctcaagtgatcctcccaccttggcctccaaaagtgctggcatgagccactgtgtccagcctagaacttccttgttagactccttgtttcctgtatgtcattttatcccctttatggattcactttcttgttttactgaagcacatcctctggtagcttctttgaaaagatcacatggaaggcaaatttttttgagtcattgcatctcatgatagtgtcttttttctttccttacatttggtttatagtttggctgaatatataattctaggtaaattttttttttcccacagaattttgaaggcttgctctattgtctaggaatatagttacacagagagacactttctgttgggcacaatttgacttaaggaagccacttaaagctggggctggagtggccatatttaggatatgccaaagtagtaatggagcagggggagcatgcatagagtgaaagacagatgcagaagccagaggccttgctgcttcacagtttgaaacggtaactgttttgcgtcctgtcccctttctagtttctgattccaggagctagaactcatgagggccagctgtacttttttattttttcctcctttaatctatggtactttgaattggtttctgtttcctccaactaaatgctccttaagacagacacccatattatctcaaacctaatctcgttgtctgcctgaatttagaaatatagccacatttctgggagagttctgaattgggaatcaggaggcctaatttctttcttttcttttcttgttttttatttttttgagacacagtttcgctctagttgcccaagatagagtgcaatggcacaatctcggctcactgcaacctccgcctcccaggttcaagcgattctcttgccttagcctcctgagtagctgggattacaggcatgcgccaccacacccggctaattttgtatttttagtagagacagggtttctccatgttggctaggctgatctttaactcctgacctcgggtgatctgcctacctcagcctcccaaaatgctgggattacaggcatgagccaccatgcctggccaggaagcctaatttctatctgtttttactttcaccagtgagtagcactggacaagtctcttcaacccctgtgtcaccatctccctgtcagtaaaaatgcaatggccaccccaagtaagagttctaaaattaaagacaaaatgagattatgtttgtgtgtgcgctttgaagaaaggcagcatctgccaatggggatgttggaaaaggattgaggaagaaggaaactgcctttccaggacctgaactatctggttacatctccactgtcaaccctgctcactgtcccacctggtggcattaggagtatttgagcactcacctgtgaatagaatggagaaaaaatggccctgaaggcggatacctgacttctggcttctggcacaacactggtaggtcccactgtgcaacggtgtgacttggcttatggtgaacatcaactgagatgatatttcaccaacaccatctatcccaggatcccttttaagtctcagctgttttaaactggtctcaggagaacagtctccagacctgtccttgcacaaaaacactacaaacccctcagcctcttctttcttatgccatacagtacagattaagtttagtcgcgttccttcctgggaagctgagctggtgatgttaatgcatcctggaatggaaagggaagaattacccagaggtcaggtagcattctgtgaatttcaccgtaactgctccttatcactagaagtcttcaaggaaggactgaagcagaacctggcagtagtgctggcagacaggaaatacaaattccagctctatcgatggctgtgtgactgtaagcaagttacctaactccttgggcagtagtttattcatctggaaaatgaaaattaagggactaaataatatgctcaaagcatccattaattcataggtttatttgttcctccacttaacaaatatgtttaggtattcactctgccaagccctgctggggctgtgaggactaggacgtgagccctactgtcagaacttttttttcccctaaccattagatgaccggggatttttaatttaaaaaatttttttttaaaacaaggtcttgctgtgtcacccaggctggagggcagtggcacaatcgtaactcactgcacctttgaactcctgggctcaagcaatcctcctgcttccgccttccgaatagctaacactacaggtatgcaccactatgcctggctaattttttattttgtagagacagattctcactatgttgtccaggctagtcttgaactctaggcatcaagcaaccctcctgcctctgcctcccaaactgctgggattacaggcatgaaccactgtgcctggccactctcagagtttaaagcctaatgtaaaaacaaattagcaaaaagttacaatttaattccacagttattataattgaggaatcttagagattcctgagtctgaagcatcagggaaacttcacagtgaagttagtgctggagctgacttgaaggatgagtaaaagtttttctaagaaatataggatgagagagaccacagaaataccagagatgattaaaaacagccactgtgtggaaatggagtgagaatggactggagaaacagactaattattgagggaccattgatatccaaagaccatgactctgatggtgccagtctgcccacttgattttccctgtaagtaatctgtaacctggatacagaagtggagaaaatagttgggttaacccaggatgttttggctcgatgggtgtctctgacctaattttgcaatgcattggccctgccaactttgtactgcccctcactctcctcaaacttcacttccttctgtagtttatattttgtagtccattattaataatctctcccttatatccaccctcagctcccttagctttactcctactgtgatggatcctcgcaaaaccccaacctcggttaaatccagctctctgctgaaaactcatccggcagatgctgaggctgccagccccctcccccactcccttggcagcttgatccgctatgacttgcttttccttttaagactccccttggtatacatagtaaactaaattcactctcatgaaaacggtgaagaggcagagatggaggctgccccctgcatattgaatgccattctcctacaagagtaagagatatgggtcttccaagacccatatctgagggagacctgcaatcccagccattgattaactccaaaatggtttatattttatttctactttccagctggaacttctatagggtctctgttagagtgcttttctgtatatcaaatcctcagtatagccatagagggcaggtattactcttcccattttataaatacacaaattgaggcacagagtggttaaactagctgctgaagttaatgaagattgcagtatctggatctcaaacctggatttcataaatttatagtatataagagcctaaaggaatcttaggttgaggcgcagattgccaggctctttgaaacatatagcagagacagagtgtctgatagagaggcaatagtatcagttctaatgaaaaagaaaaagacaatatattcttcaccctttccttaatgtcaaggagagtgagtcagccgggcgcctgaggatcacctgaggtcaggcagagttcgaggccagcctgaccaatatggtgaaaccccgtctctactaaaaatacaaaaattagccggcggtggcggcataagcctgtagtcccagctactcgggaagctgagccagcagaattgcttgaacatgggaggcggaggttgcagtgagccgagatcgcgccactgcactccagcctgggtgacagagcgagactccctcaaaaaaaaaaaaaaaaaaaagagtcctttgtttccccactagagaaaatcacgggatccagcccttcccacaagcccaggatcctccccatggccgtctctgctctagggtctatcctcaccaccagactggatgtccacaattgccagcaggatggccagggcacagcagcctctgccgggttccaacagcatcctgcacgctgtcagcaggcccaggaacttgaagcaaatgttggctctgctggtatccttggcttcagtctcctaaaagcacagggggacccactagacaaagccttccagggttccaagaccatttccccatcccaggctctagctttgattggctagagtatgatggaggtagaggagggcttgggcatgagagtccagctggctgggaagtgaggcggtaaaccaagtgagatacactgggagccggggagggaggggcatagggagacactaaaggctattttctcatatatatatttttaagttaaattggattgctgcgtcaaagaatatgatgattaaaactttttttctactataatcagattgctctccaaaaaggctgttgataatcagatgttcaccaagaatgcttgatagtgtacatttcctcgtgcccttgctagctctgggtattatctgtactttaacatttttgccaatctgatggatgaaaaattagacctgctttatgttgcatttccatgattagtgaagttgaggatcttttcatatgcttattggtcattagtattcccttgtctgtgaattgtgtgttcatattcttcacatttcttaacttttaggcactttctccgtattagagatattaacccatctgccatttttttaggcaaatactttctcccaatttgttgtttgtctcttcactttttttatgaggcttttttttcacaaggaaagtttacattgtatgtaattaaatacaacatatctatcttttcctttaagttgtctgggtttcctgcattgtttaggaaagtttccctccaattgaggctataattttctttcaatatttttattgttttactttttatagttacatcttctaatcctggctaagaaaaattactcctgtttcaaaataaacaaactgaagaaaaacaaacacttgaatttcatcaatagggaaatggtttaataagtttcaattaatctatgtgacaaaatattatatattattaaaagaatgagatacttctataaatatgggcctggagggatgttcatgatatagcattaggtcaaaaagggcaaattgcaattatgtatataaaataaatacatttttattttaaaaaatcctctctatgtgtgtatgtgttttaaaaatatatttaaggttttgtagtttataacttttgaagtggtaattacattcacagcatttaaaattcaaaaggggaaaacaagaatttttctataaatttatttttctgatttttataatcagcttgtctagtcttgcccttcctactgtgtgtaccatcaagaaaaagtcctattggtattttaaaattgggatatgttcaatttatattttaacttagggagaactgaatttgttgtgacattgattcttttgatccgagaatgtgatattcatttttcaaatatgtgtgtctcaggtatgtatagaagttttcttcataaagtcctcgtccatttcttagctaagtttgtttcttgagtaattcatattttttcactattgaaaatgtcatcttttacccattatatcttttttttaatatactttaagttctagggtacatgtgcacaatgtgcaggtttgttacatagttgtacatgtttcatgttggtttgctgcacccatcaacttgtcatttacattaggtatttctcctaatgctatccctcccccgggcccccacccgtggaacgtcatcggtgtgtgatgttccccaccctgggttcatgtgttctcattgttcaactcctacttatgagcgagaacatgcagtgtttggtttcctgtccttgtgacagtttgcttagaatgatggtttccagcttcatctatgtccctgcaaaggacatgaactcatccttttttatggctgcatagtattccatggtgtatatgtgccacattttcttaatccagtctatcattgatggacatttgggttggttcccaggctttgctattgtgaatagtaccacaataaacatacttgtgcatctttatcgtagaatgatttataatcctttgggtatatgcccagtaatgagattgctgggtcaaatggtatttctagttctagatccttgaggaatccccacactgtcttccacagtggttgaactaatttacactcccatcaacagtgtaaaagcattcctatttctccacatcttctccagcatctgttgtttccactcgttgtatcttttaacttattttttcagtctctttatatcattcattatatcttttaatttttcattattgttcatatatgaaaggctatttgttttactagatattaatttcatacccagctcccctcccttaattctatcatttttcagttgattctcttggattttccagttatgcaatcatattatgtgtacataatgataattacttccttttctattttatatctctgatttctttcttctaattgtgttggttaatatctccagaaaaatattaaataataatggtaataatgaatctctgtcttttttctaagtttaatgggggatgcttaaatgtttccttattaagtattatagtagctttgagaatgagatgtattttattatgttaaggaatatacatttatttctattttattaagagttttaaaatgtcaaggatggatgtgaatgttttattaattgcctttaaatatcaactaaaatgatattatttttctttaagatatattaagatggcgatctacattaatagatttcctaaaattgatacatctttgcagtcccagacaaacaaacaaaaactgaagccatttggtcatagtatgttgttattttcttttgagacagagtctcactctgtcgcccaggctggagtgcagtggcacgatcttggcttactgcaacttccacctcctgggttcaagcgattctcctgcctcagcctgccgagtatctgggattacaggcgcctgccgagtatctgggattacaggcgcctgccactgcgctcggctaatttttgtatttttagtagagacggggtttcaccatcttggccagggtgatcttgaactcctaaccttgtgatccacccaccttggcctcccaaagtgctgggattacaggcgtgaaccaccacgcccggcctagtatgttattcttttcatgtgctgctgtattctgttttataatattttatttaaatttttaaaaattgaaaggcccagttgcggtggctcacgcctgtaatcccaagcctttgggaggccgaggtgggaggatcacttgagcccaggagtttgagaccagcctgggcagcaaagtgagaccatgtctttacaaaaaatacaaaaattagccacgtgtggtggtgcgtacctgaagtcccagctactcaagagacttaggtgggaggagcccgggagttcacggatgtagtgaggtatgatcttcactgcactctggcctggttgacagtgagaccctgtctcaagaaaaccaaaatcaaaaattacacacacacacaaattaaccaatcatacaagatattaaaaatataatacaccatgacaaatggaataaggtttcatttttagaaattcttggatgatttaatattaggaaatctattaattaacatactactggataaaaaagaaagtcaatattaccttctgataacatcttacattaattcccactaaaatcctaagtaaaatggtaatggatgaatactattcaatataatggagaaatgtatatctcagataaaattgcagcatcatatttaatggtaaaatatgggataatttctattaatattaggagcaaggcagagatgcttcctattatttctgttatttcacattgttctgaaagtgtttgccattatatttagacaagaaaataaagcaaagggtataaatattggaaatcttaaggcaaatttattactatttatatgtgatataacttacatctagaaaacccaagaaacttaattgagaattattagaaacaataaaagagtatctgaataggcagttcacaaaagacgaaatgcaataaaaagtttttcagttttacaagtattcagggaagtacaaattaaaaattcagagttcagaatttcagaattaccacctgttaagtgaacaaaaatttaaaagataaatcaaattttggtaagggtaagaagaaatatgtgcaatcattcactctaggtagaactatacattgttacggagctttgggggaatactcattatatattaacatttcaaatgcacataccctgtccctttggctatagcttacagaaataaaagcatgagtgtgctagtatagatgtacaaggatattcactgcagcattttttataataccaaaaaaatagaaacaggtgaaggccaggtgtggtggctcacacctgtaatcccagcactttgggaggcgtgcggatcacctgaggtcaggagttcgagaccagcctggcccacatggtgaaaccctggctctactaaaaatgcaaaaattagctgggtgttgtagcaggtgcctgtgatcccacctactcaggaggctgaggcaggataattgcttgaacctgggaggcagagattgcagtgagccaagatcacgccactgcactccagcctgggcaacagagcaaaactttgtcgccttcctgcccccataaaaaaaggaaacaggtgaagacccactggtgagaatggttgaataaattattgcagatccacagaatagaatgttatgtaattatagtttgtataaaacaataaactaaattagtgtatatacatacaatttaataaggtacttattaatacataagattaaaaattttcctggatctaattattagtcagaaaatatggtagaaggaaaagttccattcattatagcaaccaaaaaacccatcaaatgtccagaaaaatgtaacaacattccgaataggacctataggatacaaactatacagtactattaaggaacataaaagaaaatctaagtagagacgattgttaaattcttctgtacttatctatacatttgtcacaatcctaataaaacatcccagcagcagctcatggtatggccccaatgtcctttcctagccttgacctctccttgttccttctcctgtgttatcataccttcatgctacaccagaatgtcctggtgactcttgaaacatggaatattaagtgacaaagaggataaatgaataaaatgacaaatcattttattcaaagaggaagacaaagaaggattgcaattattcattcagcccagaattatggttaaaaagcgtagactctagagccagagtgtttgtgttcaaatcctggtcctaaaacttaatagtggcgccgggcgcggtgtctcacgcctgtaatcccagcactttgggaggccgaggtgggcagatcacgaggtcaggagatcgagaccatcctggctaacacggtgaaaccccatctctactaaaaaaaatacaaaaaattagccgggcgtggtggcgggcgcctgtagtcccagctactcgggaggctgaggcaggagaatggcgtgagcccgagaggcggagcttgcagtgagctgagatcgcgctactgcactccagcctgggcgacagagcaagattctgtctcgaaaaaacaaaaataaaaacaaaaaaaacttaatagttgcatgactcggtcaagtttcttaggctcctgggccaggcgctatgctcagcctttaataaatagacatatttcagaaacacggagcatctataatgtgtcagacaccatggggcacagagagatcactaacacagcagaggcggacgttttagtggttaaatggtctctagagtcagaccaggatgtttcagatctggctttgaaacttaactatctgtgtaatattgggcaagtttcttaatctcttaatgacctataaaatggtgacaaaatattctcttccttgggttgtgagggtcaaatgaggtcacctatgtaaattacttagcacagtgcctggcagagagtaagggctcaataaatgatagctatgattagttttatgctttcttatattggaatcaatggacagtgttccaggcacatctacctgcaagactgtgtttagtccttataaaacactaagccattattattttctaaaatttattatttgtacgaagcatatagaggcttggaggggacttgtgacttgcttaaaatcacagctcctaagttggggagcaggactctaacccaagttatgagagtctttctcttggagtcccctttgtccctctcctcacagccgctcatccattcacgaacagctgttaacacaagaacgactgtactaagtaataaggtcataaagtgtcaaggggcagcacaggagaaattctggatgagggatgtggaaaggctgcaagatggcaatgaagttaggccttcatagttgtttgtgggctctggggagctggtgactaaagaatacggtgggtgaattaaggtggggaatgggctgaggagatctggcttccagtcctggctccgcactaggtagctgtggaatgttgacaaggtcgtgtcccttctctaggcgtgtttcctaagggactggtgcagcgggatgggaggggcgcagggtagggaccgcttccaaggagagagaggacaggcgggaggggctgatgcagctggtcactccgctggagtggccagacttcgcggtgcctagggccgagttgaagaagagcatgtaagtctgttgtgggcccctcaccagcgctggggggcagcgaggtcactgggcaaggatgctctgggaagtgaccttggtgcccgggaggggagcaccctgttgtgatgcaggcggggcagcgcggagccggcggcgctgatttcgcactctggccgctagagggcgctgcctttcagccaaagccgagtgaccccctacctgccccgcgttggcccgcgtcactccagccatgggccatccagcgagcatgggggctagccagggaaagtctaaactaggaggggagatgagggggtgcaaagttgggcctggtgggtcctggggacgcagcatgtactagagcggcacctggccctcaacagaggggagagcgggtggtcgtgagaagtctgggaattttccgggcccactacacgccaggggcgggtctcccctcttaaaacgttgtgagccccagcgcgggcaggggggagggtgcccgtggagttggcatcctcatctttgatggtccccggggctcctgagctgcgctggtggccccagggctcggtgcctctctcaggcgacagctcacagacggcgggaaactcttccctcccgcaccttcggaggcggtcctggagtcttgtggactcctgggttcaaatccaagctttgtgtgaccagcacattgctggacctcactcagcctcacattcctcttgtgtttaaaactacctcataggaatgtggtgacggttagatgacacataaagctttgccagaggttttctggggagggtggggacaagagggcaaggaagagtctccatttcctctgccaccggagcccggatctaacctctcagaggagctggaaggtcagctctgagctccacaaatacctctgtatacagatctcccacgacactgaaaaagatgcccagaaagatctcatttgcagctgtgaaggggcttctttttcaatctccacaaccccaactgccttaaagtagaaccagacttgttagtagacagaggtttgggctggggggcccttgaagctcttgtctgagatctcaggcttcctgctcaacacaccaaagcaggtgcctgacataaaggcgccatggacctctttggtggtctgggaaggcatatggagtcccttctcagaacaacatttaaaaattaataagatacatgggataataaagggaacaaattatgacaagacagttgtcaaaacattagaagaatgtgtggtagagcagtacacatgcttctttagatttgacatcagcctaataactgttgtaattctgtagtagtgctgagcgttaaggacatttggagaaatctataaaaactgtaatgagatttgaaaatatttgtgttttctattgatggcaaattctattgtggttcattgtctacattcataactgaagcaagtgctgactttcaattaaagattagtgaaaataaagatgtatttttccccccaattcacaaatcccatgaataaatctattcacggacctccaagaggtccatgacgtgaaccacctaggacatgaacttcccccggaggtgcctcacagggccagctccaagccccgtggcacctcccggcttgtctcaggccaatccttgaagagctccagcagatctaaactttggtaactttcctctggtaatttgaggaattcctccatttgaggaatgtcagaatggggccaggattcctgaatgcccatggaagaaaagcgagcatgctggtctggcgggcagaaataaccttctccccaggctccagagggcagaggacatttccctccaaaaggcaagtttctcagggacctcatgagaagcctgtcctcacctgagcagttctgtcaaccatcccatcccttcacctggaccccaggtccccagcaggcctttttacctcgagacagaagttcttctttcttgttctcagactgggggctcacgttgaaatggctctcagtcctcagattgtccttgcatcttgttaaaaccctatctctccagtttcgtcattgctcacactttcatagctgttattatattcgctctttgaaaaccacagaatgggttgttagaagtcatagatcttccgccacccccactgtggatttttttctcctttctctcctgcaactggtcctccatctccttctcctttcctctcccttgttttgtctttttggtgttagaaatagactagggtgctgagggggctaagaaaaaccacttcttaaaattcttttctttaccctggggaacaaagattttgtatttgctaattcataataaggaaaggactgatgatagaataactagaagataaaaggacagaatgtcctctcaagtataaagaaaggtaccaagtcttctcctgagagtaggttttggttagaagtaggacagagaacacagctgctccaggctgaaagggaagaaggtcagggagctgtcaagaaggcttgggtgagggtggtggtgagcaggggaggcaacgagtgggggcaccaaaatggtcctgatgtggtggggggaggatgaatgactgaccttatcttcccacccacccattttttttctttttcttttttctttctttccttttttttttttttttttttgagacagggtcttgctctgtcaccaaggctggagtgcagtggggcaatcatggctcactgcaaccttgacctcctggggtcgagtgatcttcccacctcagcccctcaagcagctaggaccacaggtgtacgccaccacacctggataactttttatttattatttatttatttatttatttatttagagatggagtttcgctgtgtcacacaggctggagtacagtggcgtgatctcagctcactgtaacctctgcctcctgggctcaagtgatgctcctgcctcaaccttctgagtagctgggattacgagagcctgccaccatgctggactaattcttgtatttttagtagagacagtttcatcatgttggccaggctggtctcaaactcctgacctcaagtgatctgcctgccttggcctcccaaagtgctgggattacaggcgtgagccaccacgctcggttgataatttaaaaaatgatttgtatggatgaggtctccctatgctgccccgcctgctctggaactcctgggctcaaacaatcctctggccttggcctcccaaagtgctgggattacaggcctgaaccaccactcccagcttcccatccatttctattctgttctgttcttccttggtcagtgatggcttgggagattacaattgttcctaaattctagggttgtgcccttagatggcaggaacattagtctgagaattagaagcattgggctctaagtcctgcaaggctgggccaggccctgtgccaaagggcacagcacaccaggaagccccacggttctggaggaacacctgtcatgattgccacccagtgccaggctacccaggaattcaagggtggagggagggtgggggaaaatttttcataactagtctagagactctcttttccttcttattcctgttattgtagtactctgtggtcctaaaaacagtagggtgctctggggtttgagaactcccagatggctccactgaagccatcgtcaaatgagacagatattagaaatatttcttcactccaagccaggcgcagtggctcacacctgtaatcccagcactttgggaggccgaggcaggtggatcacgaggtcaggagattgagaccatcctggctaacacagtgaaacctgtctctactaaaaatacaaaaattagtcgggcctggtggtgggtgcctgtagtcccagctactggggaggctgaggcaggagaatggtgtgaccccccgggaggcggagcttgcagtgaaccgtgattgcgccactgcactccagcctggatgccagagtgagactgtgtctctaaaaaaaaaaaaaaaagaaaaaagaaaagaaatacttcttcactccatcaaagtgttagctttcactgcagaatgagtccattctgggagcctgggggttgggaacccatgttgggaagaggagtgtctcaccatcatcctggtcacaggaccagtccaccacagcccacaggatactgggtcccactggcataaactgctaaactgggcctggtctctgctctcccagtatccttatttgctgtctctatgatagtgttcaaacagatgacctctctgctctctaaaatggagacttctccctccttgggtctatgagaacctttcaaaggttggctctgagagcactcagcattccttatcatccaggagctgtaaaacagtgattattagcaacatgaagagaagttaaaggcaaccagagttgtgggtgagtgaggttggggccacttaagtactagctgacacacatgtattcatactggttattgcaaaaaacctcaaagttctgcaaagacctcagggctcaaaagtgaatcgcagcgcgcttccttttcaccagccatgtagtgtctgtccatcctgcaaacggttgcatgcacagttttctgcaaatgttgcttttggtcgcttctcacaaggttattgtgtgccaggccctgcggggttgacgatgactgaatggggcctgctgtcaaggcgagcacactgctgagagaggcctgcattcccgtgagatgaagcagaagcagaatgcaccaagagctctaagtaccccagaagtgagagagaacccaggaagcaggggaggttgggaggaagaaaaggagactgccctgtgggcgcagacagtgttaggcactctgtgtggacaatgtgacatttaaattgagctttgaaagaaggcaggatttcaaaaggcaggggtagaggaacagtatgaaccagcaaggagcagggacatatggggctggtttggaagtcagtgaagcaatgaggtggctgaaatataggctgcctcctggtcatccacagcctcccaaatatgtatcctgtgggcctttcaatgtctaaggtgtatgagtccagttacacaatttagcaactgatagattgttttcaagatactaatagtaagtgctcgacattaagacaaagaaaaactgagtggacattgaattgtatttccatcttacttctgtagaattatggggttttggaagcagaagagactgcagcagtcttccagtccctggaagtgtgcagacacttgcatgccagtgtttcccaaacttgagcgtgtattaacatcaccagcagggcatctttgaacaattcggatggctgggcccagctgcagagtttctaattcagggactcagggcaggggtgggggtggtccaagaagttgtattcctaacaagttccctggtgctattgttgctgtaatgctccttgcgaactgttcagggtaatacctcttgcatcctctgcttgaatctgtctactgttctgcagctcactaccacccaaagtatccacacaatatcccttgtggaatacttccagtaaaattcttccttgtgctgctgtcagtcctgcctgcctttaactttcaatgaagtctgctgagggccccacatgggaaatgtctatggatggcaggcaagtctcaggcacatgaggcagactgcctggatttacgtcctgactccacttactacgtgaccttggataagtcattcaacctttctgtgttttcctcaactgtggaatggggataataattgcagttatatcacagaactgctgtttagagtaaatgagaaagtgtgtaaaacaattggcatggtgcttggcatataaaagtactcaggtgtgggctagtatcattacctagtgttctttttctttttcttttttcttttttttttttttttgagacagagtcccactctgttgctcaggctggagtgcagtggcacaatcttggctcactgcaacctctgtctcctgggttcaagtgattcttgtgcctcagcctcctgagcagctgggattgcagccaccgctcccacgcccagctaattttttgtattttttagtagagaaggggtttcaccatgttggtcaggctggtctcaaactcctgactttaggcgatccacctgcctcggcctcccaaagtgctgggattacaggcgtgagccaccgcgcctggccagcattacctagttttcctttctactcaggagtctatcaactctctgaagaaagttaatcattctaaagtttctcctttctgggctaaatatccccagctcctgcaattatttcttacaattattttagtgctttcacggttccaatattttgtttgtcctttctcctcttctctgaacagagtccagtttgtcagtctcccttgttagatacatggctcagacctgctacctgcctcggcttagtccaagtctcgtgtgttcactgcagccaaaggtcactttagctttgtagctatttctacatttcactggactgtgttagacttccaggccacgaaggtgccagaggctacacccgcatgtaaagagtagagctcattctcctgtcacatttccccttgttgcttagcatgtgtgagtttggggagtgtgggtgagggagagtaactctgaccttggcccagttcagggcctactgtgatggttggtgagcagccccagtggctgtgagggagcacatttgaggctccaggggctggtgcgaggcccagcttctcccctggagaagggtgaactgacacctagcacagccaacagttttctggaaggaaaccaagcctcagagccagaggcacatacagcaaagctgtgcaggcatctcagcccctgtcccagccactgtcactgctggcctttagcccagggtcgttggtaatagaataatgataaaatatggagagggagtcagggctgggtttttttggttttgctttttttttttttttttttgagacagagtctcgctttgtcacccaggctggagtgcagtggcacaatctcagctcactgcaacctctgcctcccgggttcaagcgattctcctgcctctgcctcctgagtagctgggacaacaggcgcgtgccaccatgcctggctaatttttgtatttttagcagagacggggttttgccatgttagccagtcttgtcttaaactcctgacctcaggtaatccacctgcctcggcctcccaaagtgctaggattacaggcacgagccaccacacctgacctcagggctgttttattgtggagacagaggtggcagcttcaggggtttgggtatcaagatgacagggcaggcctggaaaaaaatgtctctctcagcctctattctaatttccagtctgtagtgaatggctcaccaggtactctcaagttatgtcttttaaaacagaaggcatagaaaaatgtgcccaaattactttggtgtcctatagagcctgtcttgtccctctccggtcatagaggacaccaagttcctttgcggccaggcctcctcctaagggagaccaggcctgtggggctgctccgagagctgcctgcaagccacactatgtgaatcccagtgcagggctcctctgaaaggcacctgcgaagctgtctttggctgaagaagttggggaaactggtctcccacacttggcaatggccattctttctcaaccttccctcaggcacgaagagtcccaggtcttgatgcctcattcttccatcaaagatttaacatttaccctccctggtattttcaattgatccagaggaaatgaataggtagtacttagcaaagggtgcttagcaaaaaaatactctgctgagtggaattgcaggcacttctacagttgtctggaggcacagaggctgcactctaccctaaggcaaactggatggtgccatcctcatgctgacttgggctttagaggagaaaatgtactttcttcagtggataataaagacaatcattggtcaggtgtggtggctcatgcctgcaatcccagtactctgggaggttgaggtgggtggatcacttgaggtcaggagttcaaattcagcctggccaacatagtgaaaccctgtcgctactaaaaatacaaaaattagctaggcgtggtagagcacacttggaatcctggttgggaggctgaggcaggaggatcacttgaacccaggaggcagaggttgcagtgagctgagatcatgccactgcactccagcctgggtgacagaacgagactacatttccaaaaaaaaaaaaaaaagacaagcattgctttttccttggcaagaattctttctcttttttttttttttttttgaaacagagtttcgctctttcactctgttgcccaggctggagtgcagtggcgcaacctcggcttattgcaacctctgcctcctgggttcaagtgattctcctgcctcagcctcccaagtagctgggactacaggtgcccaccaccacgcccagcccattttttgtatttttagtagagacggggtttcaccatgttagccaggctggtctcgaactcctgacctcaagtgatccacctgcctcggcctcccacagtgcagggattacaggtgtgagccaccgcgcccagcatcctggcaagaattctaagcaacagagtaaacaggatgggcacaattagtttactttccaagctagaatgtcagggggcactggaaccattctggggaaggtaatactttgaggtggaatgtcttttttttttctgagacagagtctcgttctcttgcccaggctggagtgcaatggcatgatctcagcttattgcaacctccacctcccgggttcaagcaattcttctgcctcagcctcccaagtagctgggattacaggcacctgccaccacgcccggaagattttttttttttttttttttgtatctttagcagagacagcgttttgccattttggccaggttagtctcgatctcctgacctcaggtgatctacccaccttggcctcccaaagtgctgggattatagacatgagccaccgcgcctggcagggatgtcttttctttttttgagacagagtcttgctctgtcgcccaggctggaatgcagtggcgcaatctcagctcacagcaacctctgcctcccaggttcaagcgattcttctgcctcagcctccctagtagttgggattacaggcatgcaccatcatgcctggctaattttgtatttttagtagagacagggtttttccatgttggccaggctgatcttgaactcccgacctcaggtgatccgcccaccacggcctcccaaagtgctgggattacaggcgtgagccaccgtgcccggccgagggatgtcttttaaatcaagctacagacttgggccactaggctgttcatggttcctgattctttctcactgaccctttacctctgcatgggatggtccccagagggatgaggtcaggctgaggctgtagccttgatatacctgacactttccttgctcttctcctgttccccattctggacctttgggggcccttgagggtctggctttttaaggcagaatccaaactgcccaagaaccactgattgtttctgtatctctcagaaaggggcaaccaaatacccttttaaccaacactccaagagtgccaagaccagaccttggtacatgcaggaacccagaacatggcatgttcttgttctgtgcctttttcttatggtggaaaaggattgtgtattctgacccctcatctgggaaaaggaagaacgagtgaattactactcggatatccttggcagccagcttgcaagtgttaataattcatagctctccaaggatcctcaggcctcccctgtcctgacacttggttactgaaaagaactagaaagttccagtcagcagtcatgtggggccacagtgtgtgctgcagccaagtggcattgccccgtctccagcctgtcacccacactgctatagaacatttatctcagtcttgcatctggactctggcctaataaattcctccaaaggtatgcagagtacacagtcgcctcttaaggtgggatgaggccagagtaacagagagagtggaaagggagactgtcataaatattgactctagacagggagagaaaaccactggagcttaaaattccaggctcagagtaagttaatgagctactaaaaagacaaggtagtaggacatgcatactaggacaatcagacctgaagttggaggaaaaatgtgaggatacccactgagccaggcagactggtatagtagaaagggcattggccacaaaagcaaaagcacagagtttttagccatgtttctgcctgagggggctttggctaagtcacttcacctctctgagtctttgttttataataaagaaaaattgagatgatacaattcaataacaacaaaaacaacttgattttaaaaatgggcaagcaaattgaatagacatttatctaaagaagatacaaatggccagtaagcacgtgaaaagatgcccaacatcatgaatcattaaggaaatgcaaatcaaaaccacaatgagatgtcacctcaaacccattaaaatggccatcaattaaaaaacaaacaaacaaaaaacagaaaagaacaagtgttcatgggaatgtggtgaaattggaacctttctatgttgctggtgagaaagcaaaatggtgcagccaccgtggaaaacagtatggtgtatggtggttccttaaaaaattaaatgtatgatccagcaattccttttctgggcaaatacccaaaagatttgaaaacagggacttgaacaaatatttgtacatccattttcatggcagcattattgactgcagcctaaaggtggtagcaatccattccttgatggacgaataaataaaatgtgatgtatgtacacagtggaatattattcacccttcaaaaggaaggaaattctgacatgtgctacaacatgaatgaactttgaagacatttgctaagtgaaataagccagtcacaaaaggacaaatagcatatgattccacacatagaaggtgcttagagtagtcaaatttgtagaaacaaagtagaaaggtagttgccaggggctggggaggaaggaatagaaaatcgtgtttaacggctacacagtttcactttgggaagatgaaaaagttctggagatggatggtggtgatggttgcccaatagtgtgaaagtacttaatgccactgaattgtataatcaaaatgattaaaatgataatttttttgttatgaatattttaccacaatttaattttttttttttttgagacagggtctcgctctgtagcccaggctggcgtgcagtggcatgatcgtgactcactgcagccttgacctcacaggctcaatcaatcctcctgcctcagtctcctgagtagctgggactacaggtgcacaccaccacacccagctaatttttgtattttctgtagagatggggtttcaccatgttgcccaggctggtctcaaactcctggactcaagcattcctcccgcctcaacctcccaaagtgctgagattataggcatgagctaccgtgcccagccaatttttaaaaattggagagatcaaagcttcctgaccagattgctcaggtgtgccacatgtaggttattggcatgccaagatattgatccctttcatttttgaatagatcatgcagagctgagcacagctgaaatcctcaggcaggtcactggaagagcttcttcttactccagtatgctatacacatattgtaatgtttaaaatttcaatataatttaattattatttatacagaataagtgcatgaaacaaaaatgcatagctcggtaattaatcttaaacacctgtgtaaccttcacttagctcaagaactagaatattgccagcataccagaagttagggtcgtgtgttaccacctaagcaggaatcccccaaagttctgccctatatttggacatcatgtaaatggaatcctagtatgaaaatgaatgaactacagctactcacagcaacgtgagtgaacctcacaaacatcatattgaatgaaataaaccagagacaaaaggaatacaccaggcctgtaatcccagtactttgggaggccaaggcgggaggatcacttgaggtcaggagttcgagaccagcctggccaacatggtgaaaccctgtctctactgaaaatacaaaaaattagccaggcatggtggcgggcacttgtaatcccagccactcgggaggctgaggcaggagaatcacttgaactcaggaagcggatgttgcagtgagctgagattgcaccactgcatttcagcctgggctgtaacagagtgagactccatctcaaacaacaacaacaacaacagcaatttttaaaaatttctaaaaaccatacaataacaactatttatacatgatgaaggtgagacccagagagttaaaaatgaattactctggatcaaacacctgggaaatgggaaatggtggcgtcagaattgaactcaggtgttctttctttcttttttgttttgttgttttttttttggagacagggtctcgctctgtcattgaggctggagtgcagtggcatgatcacggctcactgcaacctctgcctctcaatcaagtgatcctcccacctcagcctccagagtagctgggactacaggcatgcaccaccatgcctggctttttgtaccttttgtagagacaaggttttgccatgtggcccaggctggtttcgaactcttgagctcaggcaatctgcccgctttggcctcacaaattgctgggattgcgatgaactcaggtgttctgatcctaaatccagattttcccattctaccttctgctttgaaagatatagaggaggccaggagggcttagccccgaggtggaggaagataagctggtatgaggaagctgctcaatgtcattttaaaccgtttatccatgggctcaggtcatgtctttgttgggggccaagccaaggcccagcaaagacaaatggctcttccagtgtgggtggaagaggggtgaggtcacccagtcctcagcctgtggtttgctttgcctcagtgccgggagcaatctcttgccctgatttgcattgtgggctgaggattcaggtcagtgagaaggccagtgatagaattgtctgtgtgggtgctgctgatagggatcagctgctgatcatggctagggctagcggctgagcacacgggcaccagcctactgctcgggcagcaaggcagcaggatggaggggtttgtaaaaatgccttccacctaccctgctgggcttgcccgagaggctctgagtgtgtgaaggggaagacaattatcgctaggctggagaatagaaagagcaccatcaggtgagaaagagaagaaaaaaagagaggggagagagtggataagaagaaggaagcctgggacacaagaacaagggctttgcttgctctagggctttgcttgctaaactcctagggagcacacaagtgagaatccagggcagagggaagcaggatgggtgccctgagtgcttggccccatttcctggggcttactggcctcgtgggtgggagttttataggctactgctccttggggaggcctcagtgattgaggatactcctgtatgagcctcggccctgaccccaggatgggggactggaggatcctaacaggattgggggttggttgggtgtaaccaaggtatctgccaaagggagagtaccaaggaaagcggaggcacctcctccctggctgtccttcaccccctctcccctccttgttctctgggagtggctggcgagcagcggcctccccgcagggccaggcaggtgggccagagcttttggtttgctgaggtttgtcagattttccagctcagggcccagccagctggcaggaagcaggacagaggtcacttgaattcagaccacatgtccctgttaaatacattagcttttaaatcaatctttgttcaaagtccagtgagttgcaagcctaatgctcacctgcagagacagaattcctgagtgaacgaacagagcagctcctcttccatctccaggtaagaactgctcgtgtcctccttgagggtgctggccaccggggcctgaactaccttctttcttttccttttccctttttctttttccaagccagtagctggctgtctagggcagagaagagtcccatggggaggcagccaggcccctttggcggtggttgggggtgagagatgatccacgctctgagattctttctgctggagatgcccctcacctttgtaggctagggtctgcttcacaaagaaattggtaaaccgacctcagaaaaagccttcccggggttgtgtgggggtttgatgtgcagccaaagggagtgagacaactgacttcacaggtaaccaggcggatatgcccgggaccttcctactgatacaggggccttgggtagcagagaagactcttctggaagcagcctttaaaggatgcagcctaacttagcttgcccactagataataaaagcaggcatctttcctctctgtatcacactgcagcactaagacatgagaaaaaccagtggatttccaggctggctgaattttaaaacatacattccccaggctctcacctttggcatttctaagtctccaggccttgtgtgaattgaaagatctttatttgaaaactctcccagaatcattctgatcagtgcaggtaggtttgggaaccactagtagtttatttcttaagcagaagactcatgagacttaagtatgacacttacctaagggttcactcgctatgaagactcctggtctgggttgggtccagctatgaagatttgggcgttggctctgagaaacacattcttctttatttactaaaatctctgcaatgtgtcaccagggcagctttcagtcttgtatctagaaggcaagagggggtagcagggactgcctcaggccatgattgtccagtcatctgaagtctgcagcaaattactcagggtctttgaatttctgtgttatgatagtaacttgtgcttatctttgacttttgtatgttctctgcaccatagggtgtgaagttgctggtaatgatgtcttatattcatagaccactggctaggcagctacttctcccccaggggaaagaacataggactggaatacaaatcatcagagttttgattcagttgctagtgacaggccattagacaaactacttagccaactggagcctcaatttcattattgatcaagtgaaggtctgtcatcttttccccaagagtgtactgaaaataaaattataagtacaaatgtgtggtcctgcatggtggctcatgcctgtaatcccagcactttgggatgcccaagcgggaggatcacttgaggccaggagttcgagaccagcctgggcaatgaagtgagacccccgtctctacaaaaaataataataaattaatcctgcatggtggcatgtgtctgtggtgtcagctacttgggaggctgaaatggaagggttgcttgagcccagggggtcgaggctacagtgagccgtgattgcatcactgcactccagcctgggtgacagactgagatcctgtctaaaaaacaaaaaaccatgaatatgttaaaaacacgatgtaagatgcctagatttcaaatgtgtatatcgaaagtctctgtagaatagtaagaagaaacaaattgcagtcacttgggaaaccttgtcctagtcttttaatctcattgagcctctgtttgctcacttacaaataagaagttgagaccagatcatcattaatgtctttttcagttggccaagtataaggtagatcctggagccttgaagggtagctccttgtcattggggtatgaattaaaatgtcacctcccaggaaggactttctaaatcagcctcccacctccatgccaccagtatctctatcattcacagcgtgtaccatcagaaatcatctcatttgggctgggtgcagtggctcacatctgtaatcccagcactttgggaggctgaggcaggtggatcacctgaggtcaggagttcaagaccagcttggccaacatggtgaaaccccatctctactaaaaatacaaaaattagccgggcgtggtactgcctgtctgtagtattagctacttgggaggctgaggcaggagaattgcttgaacctgggaggtggaggttgcagtgagccaagattgtgccattgcaccctagcctgggtgacaaagtgagactccatctcgagaaaaaaaaaatcatctcttttacttgtcacctttgccagatgttaagcttcaagactgcagggatcttgtcatttgtgttacttgctgtattaccagccccttgagcactacctggcatagaacatatttgcataaatggaattagtgtggcagggaaggagctagaagaatagatgcagatggcgatggctttgatgaagtgttcctcaggaaaggaggttgaaggactccaatcctctctcagggcatctgaagtccagggtctaatcatatgggaatgggtttctctggtcacttcttagtgaaatgattcttgcattcgttgcatagggatgcaatgagagtggcaagctggagctagacgtgttttcctcaagatctcagcaacttctttctttggtccttcatgagggactgcccagatttccttaatctctttgcctgatgggtatcatggctaagtgattaagaaaatgagcactgggattggaaacctgcactctagatcaggctctctaagcttctatttccttgtcagtcaaatgggcatattagaacctagttccggaagttatgagggttaaatgaatgcacatagtgtctagcacatcttaagtgctattgagataatcttcagacagctttgctattacatgacccccggaaatgaaggaacccagggaatggcaggagttttggaaagtagaaaagatagccctagcccacttagtggcaactagagaaggtttgcttttggtctgaggtggtcactggtttctgaggtgccaagcctggttggaggcacagatagtcagcattcataaagctgcgtagaaccatggggtcccaatggggacatgaaactaaatgatccagaaaagcccgtggactttccaccagttgtattgaatacatacctgatggtgtgagaatacagaaaggggctgtggtgcctgctcttaagaaagcttatcttggctgggcatgatggccacgcctgtaatcccagcactttgggaggctgaggagggtggatcacttgaggtcaggagtttgagaccagcctggccaacatagtgaaaccccatctctactaaaaatacaaaaagtagccgggtgtggtggcgggtgccttcaatcccagcttctcaggaggctgaggcagaagaattgcttgaatccaagtggcagaggttgcagtgagccgagatcgcaccactgcactctagcctggaccacaagagcaagattccatccctcctggccaaaaaaaaaaagcttatcttgttggggacacacgacatggatcctgaagctcctctatagtctactggactgagtccagtgctcacagtctaacctacttctttttttcaacatataactgtgctctgatctttctgaaccattcaccattctgggaatgcatctcctgctgttccttctgcctgggatgacttcctcttcctagtctgactacttgtatttccagaatacattctacacctcaggcctgggaggcagggtagatggtggaaggaatccagactcaactgggtttgaatccagactctgcttatccaaatagtcaggggaaaccaagttaacttttcagagtctcttttctttttccttgtaaaatggcccatcaggattgaatcagaacccataaaaagtacctaggctggttcctaatcctagtagggagctcaataaatatatataacaataagaaagcttttgtatttaaatattccagcacccacaacgttgttcagcagttaaacttcataactctccccactggactccaggctctttcagggcaggacggtagctattctgggttgagccctgatacctgcctcgcagtaggtattacatagaacttgttaagtacatgagcgataactgaaattcagaagatgaaatgataccttcagactgtggtggtcatggaaggattcgtatataatctaaaatttgaactgagccttgaaaatggtaggtcttaaattcgttcacttggaacaaatgtttacttagcacgtactatgagtaagtgctcatggggcatgagcaaagggcaggctcgtgtgggtgaccatgcatagaccaattggggcttgctgaggagctgggggcctgaggtagggctggattatgctgagcctcagtgcctgagcaagaagcttgaacttctttttttttgagacggagtcttgctctgttgcccaggctggggtgcagtggcacgatcttggctcactgcaagctccgcctcttgggttcacaccattcccctacctcagcctcccgagtagcttggactacaggcgtccgccaccacacccagctaattttttgtatttttagtagagatggggtttcactgtgttagccaggatggtctcgatctcctgacctcgtgatccgcctgccttggcctcccaaagtgctgggattacaggcgtgagccactgcacccggccgagcttctttttcttgaattattattattattatttttgagatggtagtataataaaaccagggttagaaagtttgtctcgaggcaagactcttgtagtagtttaaacataccaaaaaaaaagtgggggggtagaaatgcaagttcaaaaagtcacaaaatgtcgatttggggaaagcacttgtctcagctggcactcaaggcggttgagctgtctatcagcagcatgagggtgtcctctctctgtgggtgcctctgtttccacacaatattggctctatccctctcccaactcatagaactcttagataagcaatcaaactgtgaaaggccttgaactccagcccagagtcttgccatataggacaaagtattgtttatggtggctggaggtagggaaggtacttagtatcagcaggccaaatgaactttgggataagtagattccattcttgatcataaatgagaaataaaaactactcagtgggtctgggatcactcttctccagataattctcaatggaatggatttcattgatttctcatatttgaaatttatccctggctaagaccaaacagtaactatcacaatgggaaagtacactaggcaaatacatattttagaatcttgcttctccttctatttttgatattaattatttaaagtaaatatacttgagtatttgaatttccatatgctttgcttttcagaggagaaatccaggcagccttaaatatgatctgcataaaaatataggatctgttctaggtaaaatatatttgaagaagggtgaaattgagttgtctttatctcttccttgctagagacatctgtcagtagcagctcagatacagcaggatttttttgcttatgctgttggaaggaacagcatgtgccaaggctctgtggcaggctctgaaggaggccagccatggctggtgtgaggcatgaagccttggagtcagggctgatgcctgtagggaattctcagcctgtctatagttgctggcttaatgttgcacagtctccaccaactgtattttcctaacaaaagtctagtgggtttgttttcttctttcttgttacacagatgcacacaagtgctgcaagaacagcattcctcaaagtgcacactgtggtcaagcgtcctgagaatgtggcttttttcttgctaaagttcagagtgttttataggcaagcatggagttcagtggaaagcaagtaatgtctaggtttaatgttgccggagagaccctgccctttcttttccttatgcctcaacaaaacagaagtaacttactctatggtttcatactagattatacaatcagatacccttccacagtcagagtaactagggttaaacattcctcaccagcagtcctgctaagtgtttgttttttttttgagatggagtctcgctctgttgcccaggttggagtgcagtggtactatcttggctcactgcaacctccacctcctgggttcaagcaattctcctgtctcagcctcccgagtagctgggactacaggcatgtgccaccacacccagctgatttttgtatttttagtagagacggggtttcaccatattggtcaggctggtctcaaactgctgacctcaggtgatcctcctgtctcagcctcccaaactgctgggattacaggcatgagcccccgcgcccagcccctgctaagtttttagtgtttagtgttttcatggattgagtgttggttatgtaagtgccttgtggggagaggctctgttgtcttcgtggtgtgatactgacggcataattgattcctagttactattagataaggtgatggtgggttcaggtgtagatgactatatttatggaataatcctgccacttctaagtcccagaccttggaagatgagcagagatgacagtacctgggctgtttctttcctgatggtatttcattgcatctggccatcgctggtgacagcccccttctgtctttctccctccaagcagaatgctgtttatcccatgccctctctctgatcttttggcatttcagtgatgctgtctggtgagtgagcctattcactagctactccttggctatgaaggtccctctctgggccaggtatctatagctaaggtaatgcttcactcactccatcttctccactgctgtctgttccttgggtccctatgttcacttctgttagagcttatccactccaggcggtggaactctctggccagcttagtcttgaaattctgttaaagctccctggactcttttacctccttgatacacagcatttggttctattttgtaattccctggcttttagacttacaggatacttttgagtccagagtttattatttgagctttctttcatggggaacaaaatctccagccctgacttttcagcagctaaaattagcttcgcagaagtgatctggactgagtagatagagaatcccttgcctgatcattgaggtgcctgcccattcttagtctgtaatttcttcctgtcttctgcaaaaagaaaatcaggaaaaatttcaaatattctcacagaaaatgggattcccattgcatcaggcgtttcatcagaggacaggaaagagtaacttggatggagtggacttctatgctccagaaactgtgctgagaggccttgcatgctctactgtgagccatcttcacggcatccacatgtgcttcctattctaggggtattctatcttcagctcaaaattaaggaactcacccatgttcttacagttaacaagcggtgaagccaggattaaaaactaggtttggctctaaaacccttgctctttctactctaccttactcagaatcgatcctgggggaagatggaaacaaaaatacagattcccttttgtatacacatctggctcctttagaattgcatcatggggaactattctgctctaaagatcttttcagataacttttcctgtgtcaacccactaacttttgaaactgcttccacagtcccttcttctttcttcccaactcatgctgctaagctagtccctgaaacatttcatcttcccaatcccaaactcctagctcctcttatctgccaattcatgttggccccacagtctgacattccagctctgtgccccttgtaaatctagaaatcctcacatcctactcttatgggcttgttagtttgagatggagtcttgctgtgtcactgaggctggagtgagtggtacaatcttggctcactgcaacctccacctcccgggttcaagcgattcctgtgcctcagcctcctgagtagctgggattacaggcacgcacaaccacgcccagctaatttttaaatttattttatttttttttaaatttgagatggagtttcactcgttgcccaggctggagtgtaatggcgtgatctcagctcactgcaacctttgcctcctgggttcaagtgattctcctgcctcagactcctgagtagctgggattacagatgcccaccaccaagcctggctaatttttgtatttttagtagagacagggtttcgccaagttggccacgctggtctcaaactcctgacctcaggtgatccgcctgcctcggcctccaaaagtgctgggattacaggcatgaaccactgtacctggcctttattttttattttttgaggcagactctcgttctgtcgcccaggctggagtgcagtggtgcaatcttggcttactgcagcctccgcctcccgcctcccgggttcaagcaattctcctgtctcagcctccggagtatatggggttataggtgcctgccaccacacctggctaatgttttttgtgtttttaggagagatgaggtttcaccatgttggccaagctggtctcgaactcctgacctcaagtaattcacccgtctcggcctcccaaagtgctgggattataggtgtgagccactgcgcctggcctacccttatgttttaaaaatatgttagccccaacttagggtaaaagttaccactttccttttctattcttgatgtatattactgtaagaaaaatccatgggaacccatgctgctgcaagtttattatatatatatattttaacctaagttgtttcttagacattttaattcaattcattgactctttgtagtgagctaatgctgtggccattagttcactgtcttagttcaccgccagctcgggggctccattctcttttggtttacatagaatttcttttaagtttgaaatagctgtcagtttttttaaatggggacattttatgtaaatctagatttccagagtctcttgaaaattgaaaggtggcatgctggcctcctcttcctcaggcagttgtcttctcatgaaaagcagcagcttttcctccgtcccctctcggccaccttcgctgatttacctgtttgaccctagagattatttttctgtggtacttttgctccatattctccaagttcctgatttttgtcagctacttcgtaggagagattgaggctgaggtaagtgaccttgttttcttctttatcatatttttttctacttctcttctgcccctggagaagaggtatttcctctcaccaaggctaaccccagtttccatgttctccatatcatctcttgatacagaaacatgctgatcgtttccttaatgttaaaaataaaaacatccaggctgggtgcagtggctcatgcctgtaatcccagcactttgggaggctgaggcgggcggaccacaaggtcaggagtttgagaccagcctgaccaacatggtgaaatcctgtctctactaaaaaaaaaaaaaaaaaaaaaaaaaaaaaaaaaaaaattagctgggcatggtggcgggtgcctgaaatcccaactactcaggaggctgagcaggagacttgcttgaatctgggaggcagaggttgcagtgagctgagatcgcaccactgcactccagcctgggtgacagagcgagactgtctcaaaaaataaaatatcaatattcgttgcttctgttacttggtatccacttgcttcttagtgttttatcaggcccagacttccattttctgaatgtcagtggcattttctgttttcattctctctacctcttagcattatttggcattgttaactatcccatcttaaaattcttcttttagttttgatgacactaaaattttggcattttgttttctgattattcctttttgcttcctctttcttttctctctttctctttctctctttcccttccttccttccttccctcctttctgtctcactcactctgttgcccagactagagtgcagtggtgtgatctcggctcaccgcaaccactgcctcccgggttcaagcgattctcctgcctcagcctcccaagtacctgggcttacaggcacgtgcctccatgcccggctaattcttgtatttttagaagagatggggcttcaccagttggccaggctggtcttgaactcctaacctcaaatgatctacccgcctcggcctcccaaagtactggaattacaggtgtgagccaccgcatccagcctcctttttgtttcattttcctatcacttagatacaggtattgcaaaggctttatccttggctcccctctttttgtaatctcattgatgggcttcatgtagtgctgctgtgcagatggtcccaaacctcgactctagtccagcatctcctaagctctaggtgatgttccgtcaagtcctctaattgaaacctacctcaaactgacattgccatctcattcctcatgactacaccatcttttaatggcatcacatttctgccagtcatcaaagcatgaattagtttcctttgacacattccctttcaaacacacagcctgggtgggcagcattcctcagaaggtgctagagctgctgtaatagaagaccacggaaggtgtggcttaaataacatttattttctcatgattctagaggctggaagtccaaggtgtcaacaggtttgggtcctcggaggcccctctcctgtcttctccctgtgtcctcacatggctttattctctgtgcaagtgcctctctgatgtctcttcctcttttcttaagggcatcagtcctgttgaattagggtcccacccttatgacctcatttaacctttgttacttctttaaagttcctgtctccaagtatagtcacattggggattagggcttcaatgtatgaattggaagttgggggcaaaaatcagtctataatagaaggggagttcggggcttgaagtaggaaagctatccaggctggttagtagaaaatactgagccagggttatcagttcagggaaagtatacagctggcccttgcggagaagcaggcagataagtgagtggctacagagctacagtgtccttgcaacccctggactaagaggagcccaaagcacagttgtgttcgaattgagctgtggcctcagaagacttaactgtgcatttgccactctgcgacaggggatctttcctcatgacagtgaaaccagaacaaaataactacatgccaggggagtaagccatcattaggaagagtggcaggagcctgtgggccctgacactgggtgctgcacacctgttgttcctcctggacacttgtcatggtgagtgtaaagaagtgttttggacatctgtgttgtcacagctgttctgtctgagataatctctgcatggagaaatctgagggaacaaggctgaagacttactacaatgtcacttagtcctctctgtagttcctccacctctgtcaccttcattctattctgatggctgctatgtgggtcaggcaggccctttatcacgtgtgagtaggattttgacaacagcctcttacctggcctctctgcagtgtgtctttgcttgaatccagcctacctgcccttcttggaacccaactctgatcctgttattcctctgcttaaaagccttgagtggtgcccctttccaccaagctaaggccagatcccttgggctgatattaaaggcctttatagtctaatttgtcacccatgatttcccttctgttggctgtccttcaaccacattgggttttagctcttccttgacgacacccaagctttccctctttctttctctctctcttgctctcctctttctctctctctctctctcctctttctctctttcgacagtgtctcactctgtcacccgggctggagttcagtgcactgtctcggctcactgcaacctccgcttcctgggttgaagtgattctcctgcctcagcctcctcaatagctgggactacaggtgcccaccaccacgcctggctaatttttgtattttttggtagaggcagggtttcgccatgttggccaggctggtcttgagctcctgacctcaagtgatctgcccacctctgcctctgcctcccaaagtgttgggattacaggtgtgagccaccgcacctggcaaactttcccactttcataacatggtgtccacactgattggtgtctaaaatggtctcgtccttcttctgcacttgttgaaatgtcatccatatgttgttaaggctcaaatcaagtcctgcctaatttttgaaggtttccttaatttgtttcatattgtaggtcttacctcacttatactctgctcacaatgatatttttctttctttctttccttttttttttttttttttttttttgagacagagtcttgctctgtccccaggctggagtgtactggcgcgatctcagcacactgtaacctccacctcccgggttcaagcgattctcctgcctcaacctcctgagtagctgggactacaggcatgcaccaccacacctggctaatttttgtatttttagtagagacagggtttcaccatgttggccaggatggtctagatctcttgacctcatgatccgccctcctcggcctcccaaagtgctgggattacaggtgtgagccactgcacccggcaagttatttttgttctaaaactttttcttaactttattcaactataaaggctcttgagaataggggtggtgtataactttatcctttcaaccacttgacagtgttttgcatataagtgaggggcagatgcctgtggcatgaacaaatgaaatcaggtttgggtagtatgtcttcttgatgctgaaatggaaaatagaaggaactatgttcatgatcccaaacagatttcacctgccccagcatgctaactgaagaaactaattgtttgggaaagggaagagattggtagggagcaaagaactgtggagtaaatctggcaaccatcactcatcctccagggttcacgggatgactggtagggcctcagtcctgaatggattctgcccataggtttggaggaggatgaggaatggcctcagcttttaaggtgtttaggtttgggaggtggggagcaatcccctagacttaattaagagcataaagagtccatgagaacagtgaaaggttgttttatctgcttggttctatgctcccccgactcagaactagaacttggggagggaggcacaaggaacagattgcaggttgtgacacactcctatcctgctggctggggcactgattgtgggtacacaggatcccgaggactgcacggtgtgaccaagggcttctcctaatcaggctgccaccttggcctgtcaagttggataaaggtgagcccagggtggctgtgattagttcattcaatctcaacattcctctgtgacccatgagggagggagttatcctgaggctgaggggagacaggaggagtcgaggcagcctagggtgattttttttttttttggtggagtctcgctctgtcacccaggctggagttcagtggcctgatctcagctcactgcaagctccgccttccgggttcacgccattctcctgcctcagcctcccgagtagctgggaccacaggcgcccgccaccacgcccggctaattttttgtatttttagtagagacggggtttcacggtgttagccaggatggtatcgatctcctgaccttgtgatctgcctgcctcggcctcggcctcccaaagtgctgagattacaggcgtgagccaccgcgcccggcacctagggtgatttttaagctctagttcctttgatctggtttaggtctttaggtctgctttagacctgaggtggggcctaagcatcgatttttctaaatctctacaggtgattctgaggggcagctaggattgagaatcaaacttgtaaggtgattgcgagcattaaatgagataatgtgccatagagagttttcaaatgacatgatttattattgctagcatcacctgacacggtctacagagttacacaatttcaactaaattcttctgctcactcagatgagacagctggagcctttgggcatgggtggacaactaggactgaggagatgaaggaagatcttgtcattctgctgacttcactcctcaaggagttgccatttattttccttcttcagaagaagaatttacttacccctggcccatgttttgtctggtctctagcagcttcagaattccttttcttttctttttcttgagacagagtcttgctctgtcgccaggctggagtgcagtgacgcaatcttggcttactgcaagctccacctcccgggttcaagcgattctcctgcctcacgccgccaccacacccagctaatttttttttttttgaattttaggagacaaggtttcaccatgttggccaggatggttttgatctcctgacctcgttatccgcttgccttggcctcccaaagtgctggaattacaggcgtgagccactgcgcccagtccagaattctttttctttctttcttcttcttcttttttttttttttgagacggaatctcactgttgtcgagctggagtgcactggcacgattttggctcactgcaacctctgccccccaggtccaagcgattccccttccccagcctcccgagtagttgggattacaggtgtgcaccaccatacttggctaatttttgtatttttagtagagacggggtttcaccatgtttgccaggctggtctctaactcctgacctcaggtgatccacccaccttggcatcccaaagtgctgggattacaggcgtgagccaccatgccaggcccagaattccttttcaaaataacacctggaagctcataggagttacacaaagagcactcaggaacagctcccagctcagacttccagctttctgtgcagaggagttggtgagggtggtgctgaggatctcatatatcaatcctgttgatggccgtctggggcctgagagtccttggcctgccttgggctgggaagaagtcccctaggtcccaccagctatttctttcctatggaaaatagaccagtggctttagttctttctactttgccagatccagaggtcataccaccctccttttcattaccaagccttcctaacttctaaagggtatttaatgtttcttcttgaccacggccacattattctctttcctggcagcaataatctaatcattttggaaaaaagcaaaatttaatggtataattagctttttcatcaataaaattggtgaaaaaaaaaatctcattggctctcacccccgagcggttcctgtctgccagccaacactttgttctctttcccacagataaacaactttgttgtcaactattgatttttcccccccgagctcaggaatggttatagctttctttcatctccagtttttttttctttttttgaaacagggtctcattctgttgcccaggctggagtgcagtggtgcgatctcggctcacagcaacctctctgcctccaggttcaagccatcctcccaactaagcctcccgagtagctgggactaaagatgtgtaccaccatgtattttggctgtttgaactggggaacaaagcctgctggatttaatggactccaacttcaaatgattgctgctaatgatattctagaaatccataggccttcatttcttctgtgtctatccaccagaggggtctgatctctagattttttcaggaggcagaagatgaggtggggttaaagaagtaggaaagagtatccttaaatacaaagatccttcctaattaggccctgtgttccagagtcccaggcatccttgtcatggagcaatgacagagtcttgcgaaagagacataccccagctctgaattaggggacagagtaacaccaggatgtggactagacagaacaaggcctggaggtggaccagagcccagctcccttggctcctagatgaatcatctttctgcaagatggcaaaggaaacaaatagttttaggttcccatgtaagaccaggcttttgaggtttaggtctgctttccccattggtgcagctgggggcgttaaatatttaatcagtttggcctgggtacatgcagatcgatggccatagcattaatccattaatggctgtgtggtggggagtacacagtggcagaaggcagttgggggcttgcagcagtagctgtttccccaccagtatggtagcatttcactattggtataaagtggctctaattttctggcttcaaccagacaaaaaagaaactgaccttgaatgcttgagccttcaaagccatagatgcagatctgagcgattaccatctggctgtttgaaaacttcaaacaaaaaagtcaacttgagattctgccaagaaacagtgatttgtgtttctttgtatgtcaggctcacaggtctccagtgagacataggaaaacctttgcctcttcccctctctccaaacacagggctggttctcctagtgaggaggtttcactttctatccttggcctacaaacaaagagattaagagtttgtggttgacactgcagggcgtgagattgttgagtcttgggtgtgagtgccttagaaatgagcattcatatgctgatcacaaacagcctcatctcttgatgaaaacatagtatctgttggccttattctgattataaggacatattttaaattttgtaggatttgaatgaggttctccaataattactcccaactttaagagggctttgcatgttttgtttgacattgttttattttcttcacagcaaatatcattatctgaaatgatcctattcatttatgtaattactgtctgatcctcccagtaaagtacattgagacctcgtctttcttttctgattttttttcttttggggtcttttggccctatgaaatggaaaggtgtagggatctacaggtgagcttggacatagatgtgaactcaagctgaaactgaactgatgctcgcaggttgggatcagcagaaagaggagtgaaaggtgagggagctggaatgggccacaaacaggtgcctggatgtgactcaactctggtgatgccatattttctcctttcatcccagagtggtgttttcctggcagctggtcatggcttttgataaggcagagctgcctagctctcccaaggtgctggtgttgaccactggtgagtggctttgctgttttcttgcctcaatgctcgatggggagtctatttgtttgcttctttcttcgctacttagtcactcgtgccactggtggcgtggggcttcagactttgcggagactgcaggagaggcctggtattgggcagctgggggctctctgtctgatttgtactgtacgtctctgtgggcatgaaggtcagggatggctatcttcaatcaccatgccatggcttctagggtgcctggagcactttgtggcctattcttcaccctcccccatatcctgtgtggtcatccgttcttgtccctccaggagggaagggataggtggtttattctgatttgtaggtagggaactgtgatgagaggaacttgagggcttgccttgcaggtggtgtgaagagcagactccagtgctctgttgtgagccttctgccttctgtatcagcctcttgctgttctggcccctgttcttattctcctataaaagaaaaagctttcagccagcaggtgtcggggcactggcagaagtcttacccttaataataactgtgtgccggagccctagctgtcggttttacacttgtcctgtcttcctcctatggctcaggaccttgcccctgcaatggggcaacaggaggggcaggatgaatggaaatagaagctgcttcaggccaggcatgggggctcattctgtaattccagcactttgggagcctgaagcatgaagatcacttgagcccaggagtttgagaccagcctgggcaacaaagcaagacactgtctctaaaaaaattagttagcagggcatagtgatatgtgcctgtagctccagctattcaggaggctgaggtgggaggatcgcctaagcccaggaattcgaggctgcagtgagctgcgattgcgccactgcactgcagcctgggtgacaaagcgtctgggagggagagccccaacctagccactggaatcccttttctatcgagcatctcttttctgctgtggctagagacttcaggggccagaacagccttttctagtgcatctccaacatattggaccagctctaaggcctggtgtcctttttttttgaggcagagtctcactctattgcccaggctggagtgcagcagtgtgatctcggctcactgcaatctccacctcccaggttaaagcaattatcctgcctcagcctcccgaatagctgggacaacaggtggctgccaccacgcctggctaatttttgtaattttagtagagctggggtttcaccatattggccaggctggtctcaaactcctgaccttgtgatctgcccgcctcggcctcccaaagtgctgggaatacaggggtgagccactgtgcctgccttttttaatggtttaagctcttccttgtcctgtcctacctcaccaagcttctactaatccttcagttcttggaagtgtcattccttcaggaaatgttctttgttcttcccatcccgctccctattcccaagaccctttgttattttcccccttatcactgcattcttccccagcatgacactcaccacgtgtggttataggaatgtaataatgttccccaatagaagaggcaaggtatgggtccatcttgtctacagatttaacctcgattccttgaacttgaaaagctcttcaaatgtttgaatgagagtgggcttgtcataaattttttgggtcatgtatttggacttaatttctttaggtcagaggacaaagaggagtttggttggagatactgaaatggaagcatctgtgtccagtactcagtaaaaaatacgtgggtctgaaactctagtaaaaaggttgtccttggggaaacagatttggaaatcattagcaagttctggaaggtgtcctcctgtgcccccagcattactacccaagcagtctagatttggtgattggaagaacagaattataggagatggaggatggggttctcactccaattagattctcttttccatggttttattaatttatttttttcatcacagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggtgaatgagacatttggggcttttcttccaggatctcttcagcccccacatcttctctgctgattataattttgggggttggtagagtttggttctttcctggctgccactggcaaggcaggacacctttattgctgtaccttgtgttggccaatcaagtcccctatgaggaaccaagaactgtacacattactcttggatttgaatagcgttaggtctaacatgaattgcatgttcactatataccaaaaatggtgctaggtattttttttttttttttttttttgagatggagtttcgctctttcacccaggctagagtgcagtggtgcgatctcggttcactgcaagctctacctcccgggttcatgccattctcctgcctcagcctcccaagtagctgggactataggcacccgccaccacacccagctttttttttttttttgtatttttagtagagatggggtttcaccgtgttagccaggatggtctcgatctcctgacctcgtgatccgcccgcttcggcctcccaaagtgcagtgattacaggcatgagccaccacgctcggccagcaattttatattcattatcttgttaagtcctcatcatgacctcataaggtatatgttacaatttcacagattaggaagctaagtacagatatcttagcttgctaacatgttcctgctgaggatatatgggagagtctggccttaccttattctgcctgactccaaaagcatggtcttttccttacactgtgctgtccccatgcacacgggaggaatggttacaatctagggcagcgctcctctctagaaaggaccagtcttgtaagaaccctctgggctggggttgaaccacactctatattccagcagtgccagaagctcagcctaatctgcacctggatctcgggagggcagggatggaggtggctgaggaactacctgcttctacttgggtgtcaagggtcaactagcagcatctccagggccagatattgagccagatggtcagcatttccctctggcagttggcagagggttattaaagttacctttttcttcttccctcctaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtgagaattttttggggagcagggggaggcaggggcagggcacagacaacaggcttccagaacaaagatgctactggttaatgacttttcttctttgactgacttttcagttgctatagatagcttgcaacagcttgcctccctccgtctctcactccctccctgccctttcccttgccttgcacagttgtgcaatgggggagggacactggacagcagtgggggtggggggcactgggtactcctgtccctgagtgtttgtcaggctggcacttgaggactctttgaggtcagggggccagagggttgatgcttctagccctcttagggtgaaaatgaagggcagaataaggaataaaaggcaagaaaaatgagattcttcataatagctatttttgagtaagattggtatcttttttttatctgagtgcccagatagtcattcatttattcaacaaattcttgagcacctgctgatgtgccaggcactgttacctttgctgagaataccgcaaaaatttccaccctcctgtaacattttgatagtaccctcagctgcggctcagccccacctgttctgaggcgcatctttgagctctggctaagaggtacatagtgatttgagaaaccctgaccatcaggaagcaccagaagttctatttctagaatttcagaggtgcagactaacctgtgttcagttgaccgtggctctggggtattggttggaaccagaggagctgtgttagctggtcaattccttcttgaacactgcctctgcctatgttctttctggggctggagaagcactggtggtaggtcatgatttggcaagtgatacagcagcagaccagtggtaaatttaaaatagtttctaaggcttatttaacctgtaccaagagatgtaaactcacgataaggggtatttctcaggtctgtcagttattaaacacagtggtgtgtatagtcaaaggaagcttggcacgtcttagaagcctattatcagtaaagtggtaaaaaaaagaaaatcataattcagattctactcatctggctcatgtgctaatgcacatggtgaatggtttaggttagctttatgaggaaaatggtctcttcatgacaaatatataacaaggtagcaggagaaatgctgagtgtttaaggaagcagagtttaagttattgtcattccttacaagtgatttatgtagtcattagcaagcgatcccttgcctaggttgacatacaagagtccccccttatcctgtttggctttccatagtttcagttaccttacctgcaggcaactgtggtctgaaaatattaaatggaaaattccatacataatttttgcattgtgaaccattatgagtagtgtaatgaaatcttgtgctgtcctgccccgtcttggacatgaatcctctgtttgtctagcatctccacgtggcatgtgcttacctgcctgttagtcttactacttactactcagttaccaggtcaactgtcacggtattaaagtactgtgttcaaataatccttattttgcttaataatggcccagcacagaaagaaaaatatcacatattctcatatgtgggagctaaaaaaggtgaatctcatggaggtagagagtagaatgagagataccagcagctgggaagggtatgtgtgtggggtagggtggggatgaagagagctaggttaatgggtacaaacccacagagagaaggaataagttctaatgtttgatagcacagtggggtgactgtagttaacaacaatgtattgtacatttcaaaatagctgtaagaagatttgaaatattctcaacacaaagaaatgataaatgttcaaggatggatgtcctaaatattacaccctgatttgttcattatatgctcttggtatcaaaatatgacacacaccctataaatatgtacaaatgttatgtatcaataaaaaataatagctcaggccgggcgcagtggctcacgcctgtaatcccagcactttgggaggccgaggcgggcagatcatgaggtcaggagatcgagaccatcctggctaacacggtgaaaccctgtctctactaaaaatacaaaaaattagccgggtgtggtggtgggcgcctgtagtcccagctactcaggaggctgaggcaggagaatggtgtgaacccgggaggcggaggttgcagtgagctcagattgcgccactgcactccaggctgggcgataaagcaagactccgtctcaaaaaaaaaaaaaaaaaaagccaaaaatgcaaggatagtgatgctggcagttcagatatgacaaagagaagctgtaaagtggccgggcacagtggctcatatctgtaatcctagcgctttgagagtgcgaggcgagtggattacctgaggtcaggagttcgagacaagcctggccaacatggcgaaaccccatctctactaaaaatacaaaaattagccaggcgcggtggcaggcgcctgtagtcccagctactcgagaggctgaggcaggagaatcgcttgaaccggggaggcagaggttgctgtgagccaagattgcggccctgcgttccagcctaggtgacagagcgagactccatctgttaaaaaaaaaaaaaaaaaggctgtaaagtgcttctattaagtgaaaagttctcgatttaataaggaaagaaaaaatactgtatgctgaggttgctaagattagctcagttattgttaatctcttactgtgcctaatttataagttaaactctattgtaggtatgtaagcacaggaaaaaacatatagggttcggtatactatcttaaagtttcaggcctccactgggggtcttggaatgtatcccccatggttaagggggaactgctctattaatatctttgaagaattgacagcatttctataagtagcacctaaatctcaccacctaaatgcattcgggttcttccctccctcctgtgcctgtccttgttagcctacattggtgagatgactccacagcatacgatggctaatataatagtacaaactgaagaggagagaatggtaaagatgctttctgattctacaaatgcaaagaaagggcgtatgacacaataatgcagtgtgggcatgttttagcgctttctggttcaaggggccaaggccacccaagattccatctttgcatttagctgacctcagaaattctattcaaatcaacaaatacccactgagtaaaggctgtgtcaagttcagtgccaggacctataactgtgattttagatcagaagccaaaggccgagttagctctaaaatcggaagtttgtttcacattattgggagaaaagtctttaccattggatttcgagtttttctttgcaatggagtgttctgtgaaagggtggtgtatgcaaagcagtccctcaaaggccaaaggagctgagaaaccaaaggacaaggcaggcaaatccagtttgttggtacattggaatttatcaggggaacttacgaacagaagcatggtcttggacagccacaaaacatgtagatctctgtgttactccccagacccaaggctgatataccatagggaaagggtatatgtgctccagcaagacaatcgaaggcagccctccgcaatagccaagaatgctatagtgcatcatagcctataatttgcgtgataacattaaggttgacatgttcttagactagggacagtaaatgaagtagaaatcgggaggcaatcacaggactggggctaatcagaagtcaacatcacagattaccatccaagagggagtcacttgtgtctccacatggagtttacccctactctcttccaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtatgccccaaagggtacttttcttaccctatcttccactctattctcattggaggtgacaggaagacaggggtggtaggggacagcatgagtttatgatggaaaaaatatccagttgagttgccccttcatattaagggtgaacagactcacactagtggtataagcagtgttaatatagggttttggaataaagccttccctagtttcacatgaggtctacaaaattattaactttaccttttggatcttgtttgtatctgattgggagccccctctgaactgtttgattgagacagggtctcactctgttacccaggctggagtgtagtggcacaatctcggctcattgcagtctcggcctcctgggctcagatgattcttctacctcagcttcctgagtagctgggactacaggtgtgcaccaccgcacctggctaatttttatgtgtgtgtgtgtgtgtgtgtgtgtgtgtgtgtgtgtgtgttttgtagagatagggtctcactatgttggccaggctggtcttgaactcctgagctcaagtgatctgcccgccttggcctcccaaagtgctgggattatgggcgtgtgccactgcgccctctgaatttacaataagttcactgttgagccgttaatactgaaatgctttaataggaagtgggagataaccgagattttcctttgaggtcatatggaaccttaaaaattgaccaaccttctctttgtagaatgattttttgacgtggacccttactttcttttcttttccaaactccctttctagcttttatctaggtacctttatgggttttctgaattccagctcctacttgggctcagttagcacctatgtgggtaggtcatacttaaataagggaaaacaactatagaagtggagataggggccgggcgcggtggctcacgcctgtaatcccagcactttgggaggccgaggcgggtggatcacgaggtcaggagatcgagaccatcctggctaacaaggtgaaacaccgtctccactaaaaataaaaaaaaaaaaatttagccaggtgcggtggcgggcacctgtagtcccaggtactcgggaggctgaggcaggagaatggcgtgaacccgggaggcagagcttgcagtgagctgagatagtgccactgcactccagcctgggcgaaagagtgacactccatctcaaaaaaaaaaaaaaaggcgataaatacatatcagttagctggtagggcatagtgtaacagcttaaactcaggcctttcatcccctatcttttgttgaacctagagactgtgtgcctttatacagaaactttcttattccccagcattgttcttgggggttgatgtcattcctcatctgtgtgtgttgttacaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtaaggtacaagagcaggaaacttggcagtaaccagcaaattcctcatcccattctgactccagagttccattaggttcccaactcccagccagatgcatgagcggcatagcatagaaggcacagctgggtcagcgtctatgtcacatgagggtctgatgttgggcatcaaaagtttccatagcattatgataaggcagaatttgggatctgggcaacggtatcctggtaagttagctctctggggcgggggtggggggaaatccaaattggtagcgtttgtttttggtaccaaattggtagtattttgtgatgtaaatactcctcccatgtccagtttcaacttactaacacgatgtcactgaacacaatgaagtgttgcacagaattggcttttgtgagccggtgtgagccagtatagcacaccgctggacctgaggccgaggtgtgggtgaggatttgggactcagaaccaggagtcctccttccttgcaactcaataggaagaacactaggttctttcagggaaggtaaatacataaaagaacatgagttcgggccgtataaactgctattcgcccataagttgttattttcttttcactctctgtttacattaatttatcaaatattaatttggtttgtgttttgtaaaaacatcctcagtgccttggagaaagaatatcatatgaagcagacaggaattctttagtgaaggagtctaccatttagtagataagagatatgtccataatgaagggagatagaggttaagtaccttcatacaggggcagatcaagcactgtgataattcaacgttagagtaagcttttctcactaaaaaggtaccagaagccctcatagtaggggtggcacttgagttcaggctttgtaacatgaatagatttgggaaagtagacagagctgggataaggaagatcattccaggaaggtgggaatcatgtgaacacagtcaggagacactggcacagtttaattggcacatgatgtgtagtacaagaattcgttggaaaggtaggttggagagaggtgacaaggggacttctatgcaagactgatgagtttgaacttggcttatcagacaatggggagttgttttttgagcagtataagggagaagaacaaaaaccagcctataatgtcttgggggctttgcacatctcaattactcctaacaattatgcaagaagaactgctgaaattgagggcttggagaagatacagtaattatgtaaggtcaaatagttgtttagttccaaagcccatgctcattctgttgcaccaggaagtgacttggttaggaatgtgcaccaagatggatctgaaggcagatctgtatcagacagaaggactggggaagggaaagcagtaggtaaggtgctgtaatagtttaggtagaattctaggcaggaactaatacaaactgcattcagggtagaggaagtgggatgtgtaaggtattatggtagcatcagaggacttagcaatcgtctagatatggggactggatgctggggaagaatcagttgccaagtgttggtgactgggatgatgttgctccactaacaggtaaccaagaggaggggctttgggatggagaatgggcagagctgatttttggcttgaatacattacagttgagagatctatgagatattttgttggagatacccagcagctagctggaaaagtgaaacaggaacttgttaaaaaaaaaaaaaaaggcagcatctggtgaagataccagaaggccaaagcacatggaggcatgtatatacaaatatattcaaaaccgaacacacccaattgctactaaaatgccagcctgggtttcttaaggtccaaagttttgggttttgttctttattcttccccatcttttatgacagcttttacataagacgcgtggctacaagtatgcccactgactttctgggaacttgcagccttttaatatgctattttgccaaaatcaaatgtcagacgcttttagtaacaggattattttcgttaagaccccttcattgttaattgctgggttagtttctggggtgagttctgagcaggaaacgagcctagatagtgtgcttataagcttcctgggatgctggtggaaggggtggtagttgtactcagcatgccttttttatctgtttcatcagggctttgggctccagcagaaaatctgttttatttttttaggggacttactgataattttattttttggggttgggggagggtaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggtaagtaatacaaggccatatattcatgcattaaggctgggcccattcactcatgacctcaacttttgcactgagttaggactttgttcctcaaactggaagaggcataacaatcatcattaaggctaaactgaagctcaactcaaattggtagtgataagagaatgccaaatgattgataaatgagttttaagtccttggtcttaagattttgaaagaatttgtgaatataactgcaggcttactcttggtgatctgagaaaatctatggagaatataagcctggaaataaaattgttcccaaaataggaaacaattagattttaagctttaggtcagttaagtgctatcaactgcacataaaagcctagaaaggattattaaacaacttgtaagcccttagcaaataaaaaagaaacacagatagaccaagaccaacctgaatcaaactaactttattttctcttaacagctctttatcataacacccactactgcatgttttaaggttttttttttttttttttttttttttacttttaacacaagaactgaggttgtctagtttaacagataacctggggggccttctaagtaccatctgtcttgctaagtgttgattgtaaagatgaacaagataaatgtcctctgtgatatacaatgatagtagaatctaaaataagcggtacagaggggggaatatgatgggtggtgatatcttaggccctcctcatagattaggaaaccgaagcttagagagactaagcactttgctaaagtcacgcagcttagtaaagactgaaggtggtatctgaacccaaattcttggacccgtaattcattataccatactccccagcacattttttcaagataatcttgtaagcaggattaaacaattaattagattaatggctttttttttttagctacttgaacaatcatacctagaaaatacttgatatcaacctgaatatcaacttgaatagaagtctctaatggcatgctacttgttcctaaccgtttatgtgcttaaagttgaaaggagatatggaaaatatattaacatacttaaagtggcactagataattcatttgctggatggtgtaattaatactcaaaatatttagttaggatagaaagaatgaaaactaaagaaataagaataaatttcagatgtactatactaacctaaaagtaaattgtatgaataccacatggtgagacctgatttgaggactacagaaaaagaccagaaacttcatagtccaagtggttgccccatccaaatatggtaatttaaaaattaactgacagacacttggcttctagagatgaccatcttactgtacttacttggtcagaccatacttggaatacctggtaatatagttaccacctctctctgtgcttcagtttccttagttgtaagagaggggtagtagctacagcgaagggtggctatgagggttgaattggaatattcagagcatgtagaataatgcctcacacatctaaatgttctatttgttcaatcaatattgtgtccggtttcaagaacttcactttaagaaggcaatgacaagggtaaccagggaagaggttttggaagccaccatgtgagtatttagcttgagtaaggctttggagaagagagcatcttcaagaatttgaaaggctattacatgtaagaaggagcacactttttttttttttttttgagacgttgtcttgctctgtcaccaggctggagtgcagtggtgccatctcagctcactgcaatctccacctcccgggttcaagcgattcccctgcctcagcctcctgagtagctggaattacaggtgcgcaccaccatgcccagctaattttttgtattttagtagttttaccatgttggccaggatggtctcgatctcctgaccttgtgatccgcccgcctcggcctcccaaagtgctgggattacaggtataagccaacacgcccgggccacacattttttttaaggtgtcctatggggcacaacaggaccagagaagccatagggagctagcttttggcttaagaaccaactgaagctgccagaaatgatgagtcattttgcagttggtggaaagtcaagcagaaatcagaggcggctgctgcagctgtttgttgtaaaggggattctgacccctcctgatcttatcatagaatgatttaattgtaatttttctgttttggttaatagagaactttgatcgaaaaagaagcctgccctcatcatctccttccccgctctccaaagtaagccctgtaggttggggtggagggtagatctttgagatacatcagtgagtaaaacacaaccctctagcagtccctggcacatactagacacccaattatctgaatgaagcatgaataaaatctcattttttttttttgagacagagtctcccgctgttgtccaagctggagtgcaatggtatgttctcagctcactggaacctctgcctcccaggttcaagtgagtctcctgcctcagtctctcaagtagctgggactacaggtgtgtgctaccacacctggctaatttttatatttttagtagagaatgaggtttcaccattttggccaggctggtctcgaactcctgacctcaagtgatccgcccaccttgtactcccaaagtgctgggatttcaggcatgagccaccaagcccggccaaaatctcaagtgttttaatgttattgcactttgcctcgagatgagctgcgactgtcagatacagttgatttgcttgtttgggtagtgttatcagacgtatttttgcatgtaatgagtcacctgataattttccatattttaaagagaaaggctccattgtggaactgttgcaagtatatgactgaaaggtctgaagttagttgaactgggtaactaggaggttctgtgctggtggtattctcacttagaaaggaaggagatgtggtcttgtggttagtaagacacatgataaccagaggactaaaaatctaattttagtcaggctgctaaacagtgcgatttgaagtagagcccacactgtgctcaccttccattgcttgatttcctactcatcacctaacaaatgttccggacacgtgtgggcagccatttagctgctgatccaggatcacaccatacccaggtccacccttctaattgtctcaactaaaacagccagttaggcttgtaattctattacaaaaaaatcaatcctgtttcctgttctatgcctcttcggtattcaagatcatcatttctttacatggatggtctgggagttgatatgaattaggagtatttaaagatgttggagagtttggcataatagaagtgacagctaatgcttacaacaatacatagcaaaataaataagcacagatcccaggtctggaaggggagggtattggcaagcagcaaagggttggaattaacttttgttacaatatgtgaccatataacagctgtcaccctctcaccaattattcctgtgtatatgggttggtctcttctagtagctttgaatctttggatagtgataaaaatagtgttatattaacattctccagagagacagatctagtaggatatagatacaggtatgagaggagattaattaggggaattggcttgtatgattatggaggctgagaagccccacgacaggctgtcttcaagcttgagaccctgggatgccagtagtgtggctccgtccaaatctgactgagccacattactggcatcacccctgattggcagtcctacttgtttgcttctgtgcatttggcctgagaatctggggggctgcggctgtagatcttagagtccaaaggccggagaaccaggaattctgatgtccaagcacaggagaggaagagggtatcccagctctagcagacagactgacacctttgccttttctgtagttcactcagactcgcatgctaatcccctctggaaccaccttcacagacacacaccaaaataatgctttgccgggcttctaggtattccttaatccagtcaagttggcatctaaaattaactatcacaagtgtcttgtgttttactttttctaatgtgtttaaggagctctgaagaccatcttaccgaaaggaaaagccagaagaatgtactctgcatgaggtaccggctagtcggtcagatatgtcatttcccaacagggagattatgtatagcttgttcagtgacttgctcactatcatgaactcactcaaaagaaactagcaattttttagacttcttttgggatccttgtaccgcatcctatactgcttttatgttcatgtgtgcatttgtgtacatgtatacacatattactccataacgaagcacagtcttcttttatacctttcctggttggggtagtagaggaattttacagcctacaatcagacacatccagaagaagagtggaatatgtatgataccttaaaaatcagcacatttaacaaagtataacttactcatggttacaactaagttaatgttttttccctttatttttcaaaaggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtatggtaatctggttccagcagcccaacaaacacagccacaattaggatagtctcagcttttcccacccattgatggcttagtagagaggttccattgaaggcacacactgaggggtctcacttgggttcagataaatgttgtcatggtcccacaccctttaggttagctaccagtacatcataagctcacgtttgtttgtttcccaaacatctgttccaaacagtgtgagttgactgaactctagttgacagtcactatcaaccctgattggcagtcatatttgtttgcttctgtgcatttggcataatgccccttaccctgtagggactgataagaatccctaaagctttcaagttgggagtgaagaagggggacctatttatcccccttcatcccagaagacatatgatgctgaaccactatttataataccactaatcatgtgaatatggaagttatagccttcataaatataaaagcattagaacacctttctcaacttctatacctcaaggagaaataataacatgattaaaaataaattcttgagctcctcatctattctcttaaggagagctagtctgatgtccccttctctgtttgaaattgataactcagaacttctgttcacaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggtgagtgggggcctatttcttttcgtgatctaatttactagagtatgggtacagtccctatgagtatatttaatgtctatgtttgccacagatttttttaaaactagaaaatgaaaatgtaaagataactaacaaatcaagttattgtagaggacaggaggcagtataagaacaacaaatttcttactttcatagcatgcagctgacagcaactgtctagagctaataaatcaagaagtaaaaagtttatcagtattgtaatgggaacccccaaaagagcctgaatcggatgatctagatatgaattctggttctgtcatttgtcagctgtggggaaatggatttatttgttctgttcctcagttttcccacccataaaacaggaataatttgtaggattgttatcaggatcatgttaactaagattaactatattaaagtgctttgaatagtggctggctcatagtgagcatgtaagtggtgacggttaaagacaatattgtttaaaacaactgacaggtaatccagttttattactaggaaagattaagcattctctatattattctctatatatttggattaaatttcttggtaagtctcagttttatatttttgcccaatttttcatagatgaacttgaggtcgaaaagtaaactgacttatccaagttcataaaggaaatttatagcaaagccgagactctaaaaaagtttaattcaatgttgttcttctttccattatattaattctgctaatgggtggaatattcattttaataaactcagtttaatgaacacacacaatgcccactgatttgtattcaggaatgcttaataaatactattagttgtattagttgtcatttaaaaattctgtaatttctctttaggaagtcaatatcctagtcttataaaaaagaaatatacacagacattaaggaatttgttaatgtgtcaaacagcaagttgaaaacaatcaagtgtagaattcaggtcacctgacttctagtcatacccagatcatctgattcaggctcttctgggggttcccattacaatactgataaactttttacttgatttatcagctctacacaattgctgtcaactgcatgctgtgaaagaaagaaattctagtgagtgactctactccccgacttaagtcatgcaactctagaatagatcatccctctttcattactctaccatttgtaaattctttgttttcttatacacaggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgccttttgagtatgcttgatagtgcttttgttttggattcactttttatgctttaaccttcatttgcctctagaaacccaaaacacaataaagtacagaataagaccttagtaataaaattcagaattttcttaaattgcatgtctgagtgttctaaaaatttttcaacatttccctttcacaagtgacttattcccccagttaagttattcacggtttcaccccacagcgtgaggggcagatagaaaaaaaaaaaaggaaacatcactaccgaattgaaagtagggtataatactaagttcacaggaaatcaagaaaaaatgacatacctgaaatctctcttttggtaaaatctatttcaggtgcataccacccctttcccggaaaagaacagataacctctttcttggttattttaatggggcaggatcagatgaggaggtgtgggatgctaactgatgttagatcacacaagcataataaataccaagctatgcttgataaaatgaacgtaaggcaaaagtgttacagtctctgattttaatgagtcaatctcaaggcaaagctataaccttttccatgtgaaccttaaaacggaaatcctacgtgtttggctcagctaccatagacatgtcttgccccagagttccagtgtatttttcacctttagtttcttggctcctctccgcctctacaccagcctcatatccacacgggatgctctctgctgagtattgtcttgagttagttctccctctcatgttctggctgatgctactcatggtcatagtatcacctgacggggaaggagtatgctatgaaggtgaaaaatgctaccatagcattttgtttgtttataaaatgtcaggccctggttccatttttcccccctcttatatctaaattttgaaaccactggcctctaacagtctgtagtaggcttaagttcaaggtgccatttgcttctctggtgcctgtttgtgagccaaatagaggaagagtatgctagagagagcgctgaccaggaagatcacatcaaaccaacggtgatagaagttgaactgcagttctccaaggacttcagtgattatggtgcggtattctaaaggcatactcattcggatcagcagcacagaggagacaaagtacatgccctgtaagtcaaatgaattaatccagaagtgactctgaatgtagtgaggaacaggacaaaggaaattattaaaattcttaaaagtatcaagcacatttctgatattttacagctgtaaacataaaggtaactaattaaacttaccattatctgtgctaatagcaggacaatgacattggaggacttactgctagagatggcataaaagaactgtcaagaaagagggagatgaatttatgcagtagtgttagattcctgtgtcacgaacagtaagaaatatggttaacatttgattaaaagtgtctcttccatgccacaatcctgtatagaacaattcatatgattaagactataaagaagagacttaaaatagactgctgaaaaagttatactttccccctgggggtaatttaattacataacatatgaaaggattcctattgctatcaaacttcagaaactatgtgatacatatgacttaacatcactataaaacattaagtcagatcactccagcccactccaagcggttgtaattgttagtaggctcccacgctctttctaaaactgtgctagatgcctgcagatcccttcctgtcccagccacttctctttcattcaaaagctcctggatttttaaatccctacctttcctaccagagaggactcactttccacctccgtgaagtcttcctacgttgattagaaaatagatgaattcaggctttggtatcaggatgatgctggcctcataaaatgagttagggtatcatcctgataccaaaacctggcagagacacaacaaaaaaagagaattttagaccctgatgaacatcgatgcaaaaatcctcaataaaatactggcaaactgaatccagcggcacatcaaaaagcttatctgccatgatcaaatgggcttcatccctgggatgcaaggctggttcaacatatgcaaatcaataaacataatccagcatataaacagaaccaaagacaaaaaccacatggttatctcaatagatgcagaaaaggcctttgacaaaattcaacagccctccatgctaaaaactcaataaattaggtattgatgggacgtatctcgaaatcgtaagagctatttatgacaaacccacagccaatatcatactgaatgggcaaaaactggaagcattccctttgaaaactggcacaagacagggatgccctctcccaccactcttattcagcatagtgttggaagttctggccagggcaatcaggcaggagaaagaaataaagggtattcaatcagaaaaagaggaagtcaaattgtccctgtttgcagaagacatgactgtatatatagaaaaccccatcgtctcagcccaaaatctccttaagctgataagcaacttcagcaaagtctcaggatacaaaatcaatgtgcaaaaatcacaagcattcttatagaccaataacagacaaacagagagccaaatcatgagtgaacgcccattcacaatttcttcaaagagaataaaatacctaggaatccaatttacaagggatgtgaaggacctcttcaaggagaactacaaaccactgctcaacaaaataaaagaggaaacaaacacatggaagaacattccatgctcatggataggaagaatcagtatcatgaaaatggccatactgcccaaggtaatttatagattcaatgccatccacatcaagctaccaatgactttcttcacagaattggaaaaaactactctaaagttcatatggaaccaaaaagagcccgcattgccaagtcaatcctaagccaaaagaacaaagctggaggcatcacactacctgacttcaagctatactacaaggctacagtaaccaaaacagcatggtactggtaccaaaacagagatatagaccaatggaacagaacagagccctcagaaataataccacacatctacaaccatctgctctttgacaaacctgacaaaaacaagaaatggggaagggattccctatttaacaaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataacattcaggacataggcatgggcaaggacttcatgtctaaaacaccgaaagcaatggcaacaaaagccaaaattgacaaatgggatttaattaaactaaagagcttctgcacagcaaaagaaactaccatcagagtgaacaggcaacctacagaatgggagaaaatttttgcaatctacttatctgacaaagggctaatatccagaatttacaaagaactcaaacaaatttacaagaaaaaaaacaaccccatcaaaaagtgggcaaaggatatgaacagacacttctcatgtgcagccaacagacacatgaaaaaatgctgatcatcactggccatcagagaaatgcaaatcaaaaccacaatgagataccatctcacaccagttaggatggtgatcattaaaaagtcaggaaacaacaggtgctggagaggatgtggagaaacaggaacacttttacactgttggtgggactgtaaactagttcaaccattgtggaaggcagtgtggcaattcctcaaggatctacaactagaaataacatttgacccagtcatcccattactgggtatatacccaaaggattataaatcatgctgctataaagacacatgcacacgtatgtttattgcatgtgcaatattcatactattcactattcacatactctattcacaatagcaaagacttggaaccaacccaaatgtccatcaatgatagactggattaagaaaatgtggcacatatacaccatggaatactatccagccacaaaaaaggatgagttcatgtcctttgtagggacatggatgaagctggaaaccatcattctcagcaaactatcgcaaggacaaaaagccaaacactgcatattctcactcataggtgggaactgaacaatgagaacacttggacacaggaaggggaacatcacacaccgaggcttgtcgtggggtggggggaggggggagggacagcattaggagatatacctaatgtaaatgacaagttaataggtgcagcacaccaacatggcacatgtatccaaatgtaacaaacctgcacgttgtgcacatgtaccctagaacttaaagtataatttaaaaaaaaaaaatagttgaattcagtaggtccttacttaatgccatttataggatcttggaaactgagattttaagtgaaatgatgtataacaaaactacatttttctcacagcattataatgaaatgttgaacgaaacatttttttgaggacttggtatatagttttgcttaaagctgctgtttccaagaacttattgatgacattaaggacttgctatattctgctcccttacttccatatcttctctgtaagtgactctcacaactattcttccagtctcaaatatctgctgaatatctgcctaccatgtgctaggttctgttctagatactgataacatatcagtgaacaaaacagacccatatcttactctatcacctttagtgaatgtacttatctataattggtatatgatgtaaatatatcatcatcaatttatgtagtagtttaacttttaaaaaattctgttgtatgtcttttaaatccttgacactgttgtttaaagtctcaggaggcagaattcttaatgaggtaaaattatctcatggtaccacctatttttttttttttgagatggagtgttgctctttcaccaggctggagtgcagtgtgtgaccttggttcactgcaatctctgctgcctgggttcaagtgattctcctaactcagcctcccaagtagttgggactacaggcatgtgccaccacacccagctaatttgttgtatttttagtagagatggggtttcaccatgttggctaggatggactcgatctcctgacctcgtgatccacccacctcagccttccaaagtgttgggattacaggcgtgagccaccacacccggctggtaccacatttaattaaacaaatgataagcagtactttttaacactgtgataaaacataccttggtaagagtgatcagcaatcctctgatggatgtgacgatgattattccaacaagaatgaaggaaatgtgttgggaccaaaacttcacctgccaccataacaagaaaaaatatctgctaaatctctgttcagagagacgtaagggctaagctatatcccgatcatttacatgactgtgagagggagctttattagaccctacctgattttttttcttaagggagagaggaaagcaagtaggtggcaaataaaacaactacagaaagactgcagtaaataccttaattagcagacttaattaaaccttaaaattaaaaaaatattttttttgtagagccagggtcttgctatgtagttcaggctcgtctcaaactcctgggctcaagcaatactcccacatcagcctcccaaagtgttggtattacaggcatgagtcaccatgcccggcagcaagtaccaagaagtgataaaaataacgctaataaatcagaaaaaaacagaactaatgatacagttttactgtgataaacgaaaagcaggaattaaaaggaaactaaataataccttgattattttctatctatgaataatagttccctaatcaccaaaacttcaaggaatctttctttttatagtaaaagaatatatagacattctcagctaaattctaggaaatagttgaacttcactggaaccacatgatacctttttctcctcctgtattgcttcatagtgagaaggagttttgggaccctgtgtttgattcagttctgaaaagtatctgaaagggagctgctattactaacatctaaacgatttgttattcagaattacaaaatatagcataaacagatgaattacagatgaaatatatacatggccatgtaagtatcctcagaaagtacagaaaagcaaaagcattgctaaaaattcagcccagtaaaacacttaaggaaacacaaatgcaacaacagcaaagcatactttttgttgttttttgagacaggggtctcactctgtcgcccagagtggagtgcagtggcactatctcagctcaccgcaacttctttctccccggctcaagtgatcctcctgctttagcctcctgcatagctgggactacaggtgcatgccaccatgtccagctaatttttatattttttctagagacaggttttcaccatgttgcccaggctggtcttgaactcctggactcaagtgatctgtctcgacctctcaaagtgctgggactacagatgtgggccacagtagtgcgtggcctgtaaagcatatttaatataatttatataccacttgaagaaaagatatcatgttccttcacactcaaagaggatacactattgatctagcatcaagaaacatgtacattgagctgtttctcaaggattggggctcaatttgctctcgttcattttcatttcatccaagtccttttgagattaggggcacgtctggctgggatggatggctgggggtagcacgcagtctgcgtctaggttgacagcacagctaaatggcctacactgggactaagaatatgacattggtcttactattaaagtgctattcagccagagtcattggctctggtttatgaataaagacactgaacttcaattaggacaagggtgtatttatgacagtggtattatgaaacagtaaaaagacaatttaaaaaaaaattttgtgcataggtgacagttaccatctttagcccaaggtccacattaatagataaagatcatttcttacagcagaaatcatttcagctctaacacagaacactaattagtagctaattttccactggagcatcaaagctgagttgtgtgtttgaagagcttaataagaatcacagagagaagtatttgaatactttggtggggagaaaatggtaaactggtagctgcctatagagaagcagaggagcagctgtagaaataatcagcatccatgacaatattaagtatcaatcattacttctggctttatgttaagagagagaatcttggccttttacaaattttccatgtgaatacatcaaaatataaaaattttccatgtgaatacgtcaaaatatacagagtgggaagaacaaaagcagaagcaagtacctaaagtatacaaattagaatcttaacaatggtaagttatagtagataaaacagaaacatgacaaaccaggatcttgatataacacttacatcaaattggattcccagataattcacagtgatctcaatgcctcttgtgacaggatccgttttcccaactcgatcaaaaacaatattgatggtagcctgcaaagatgcagatttttaccttggagcatcttaacaatcacttactatttcaaaaagtgactgaaactaatgaattaatcactgtaacatatcttacaggtcaatgttcctaaaaatgcaattctactcttaatccaaatcatatataggaaatctattttggatactcatatataggcaaacaaaagtccctatttcctccatctttcttttctgtaaagagtcaatgggaataaagctacggcattatgccttaatttatcaggagccagaaaggtaacattctggtagatgaagtcagattaagagaatcaagaaatcccagggtaattccttgtggttattttctgaatgctttaacagcaaatactaaaataacagaaaaaggagttatagctaataagtcaacaaacgatatcaaatggaataatgaaaaattcccaattaatccccaagatggaagtttaaaaaaaggaaaaagggagaaaagaacagatgggaccaatgaaaagaaatagcaacacagtagtttaaaatccaaccacgttaaaaaaaaagaaacaaccacatcaataatcacatgaaatgtaaatggtctgcataataggtgagcaaactctgccactggagtgtgacagcagccacagacaatacacaaatgaatggacttggctgcgttccaataaaactttatttccaaaggcaggcagtggttaggtttggcctgtgggctatagattgctgatccttggtctaaacatgtcaatgaaatggcagaggttgttagattggataaaaatgcaagacccaactatatattccttatgaaaaaaccactttaataaatataaagatacaaataggttaaaagtaaaaggacagaaaaatatattatgctaacactaatcaaaagaaagctagaatgtctatattaatgtcggacaaagtagatttcatagcaaaaatactgctaggtattaaaagggtcatttcagaatgataaaaggatcatttcaacaaggggtacacaatgattctaaatgtttatacacctaatgacagagcttcaaaatacgtaaagcaaaactgatagaaataaaaaagaaatggacaaatccacaatagctggatcccctctctcaataactgataaaattagtcagaaactctaataatactatcaatcaatttgacgtaattgacatttatggaacactcctgccaacaagagcacaatacatattctactcacatacaggtaagacatttatcaccatattctgtctgggacagaaaacaagtcaataatttaaaagattcatatcatacaaaatatgttcttagaccacatgaaattaaattagaaattaattagagaataatatttggaagatcctcaaatattttataacacacttctaaatcacccatgaatcaaagaagaaatcaaagggaaactcgaaagcattttgaattgaatgagaaatacaattcattaaatttgtgagatctagtatagcagtacatagcaagaaatgtatagcattaaaacccctatatcagcaaagatctccaatcaatgatcttagtttccatcttaagaaattagaaaaagagactcaaaataagcagaagaaaggaaataacaaagaccagagcagaaatcaatgaaatagcaaaaaatgagagaaaactaattaacccaaaagttggttctttgaaaagttcaacaaaaccaataaacttctactagactgataaagacaaaagagggaagtcacaagttaccaatattaagaacaagagagacatcactgtcacacccatgaggatggctataataaaaaagtttttattttattttattattattataccttaagttttagggtacatgtgcacactgtgcaggttagttacatatgtatacatgtgccatgctggtgtgctgcacccattaactcatcatttagcattaggtatatctcctaaaactatccctcccccctccccccaccccacaacagtccccagagtgtgatgttccccttcctgtgtccatgtgttctcattgttcaattcccacctatgagtgagaacatgtggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtcaatagtgccacaataaacatacgtgtgcatgtgtctttatagcagcatgatttatagtcctttgggtatatacccagtaatgggatggctgggtcaaatggtatttctagttctagatccctgaagaatcgccacactgacttccacaagggttgaactagtttacagtcccaccaacagtgtaaaagtgttcctgtttctccacatcctctccagcacctgttgtttcctgactttttaatgattgccattctaactggtgtgagatggtatgtcattgtggttttgatttgcatttctctgatggccagtgatggtgagcattttttcttgtgttttttggcggcataaaagtcttcttttgagaagtgtctgttcatgtccttcgccaactttttgatggggttgtttgtttttttcttgtaaacttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttggtatgcttttagacatgaagtccttgcccatgcctatgttctgaatggtaacgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaataaggaatcctttccccattgcttgtttttctcaggtttgtcaaagatcagatagttgtagatatgcggcgtgatttctgagggctctgttcggtgccaatgtacaaaaatcacaagcattcttatacaccaataacagacaaacagagagacaaatcatgagtgaactcccattcacaattgcttcaaagagaataaaatacctaggaatccaacttacaagggatgtgaaggacctcttcaaggagaactacaaaacactgctcaatgaaataaaagaggatacaaacaaatggaagaacattccatgctcatggtaggaagaatcaatatcatgaaaatggccatactgcccaaggtaatttatagattcaatgccatccctataaagctaccaatgactttcttcacagaattggaaaaaactactttaaagttcataaggaaccaaaaaaagcccacattgccaagtcaatcctaagccaaaagagcaaagctggaggcatcacgctacctgacttcaaactatactacaaggctacagtaaccaaaacagcatggtactggtaccaaaacagagatatagatcaatggaacagtataaaaaagttaataacaattgttggtggggatgtggagaaattggagcacgcatcccctgctgacaggaatgtaaactgttgctgctgttttggaaaagtctggtagttctttaaaaggttaaacataggctggtcgcagtggctcatgcctgtaatcctagcactttgggaggctgaggcgggtggatcacaaggttaggagttagagaccagcctggccaatatggtgaaaccctgtctctactaaaaatacaaaaaagttagccgggagtggttgcatgcgcctgtaacctcagctacttgggacgctgaggcaggagaattgcttgaacctgggaggtggaggttgcagtgagctgagactgcaccactgcactccagcctgggcgacagagctagactccacctcaataaataaataaataaataaataaaaaggttaaacatatacttagcatatgacacggcaattctacccctagatatacacataagagaaattaaaacatatactcacataaaaacttatacacgaggctgggcatggtggctcacggatataatcccagcactttgggaggccgaggctagtggatcacctgaggtcaggagttgagaccagcctggccaacatggtcaaacctcgtctctactaaaaatagaaaaatcagccaggcgtggtggtacgcacctgtaatcccagctactcaggcggctgaggcaggagaatcgcttgaacccaggaggcagagatcgaagtgagctgagatcaccccactgtgctccagcctgggcaacagagtgagactgtgtctcaaaacaaaaacaaaaaaattatacacaaatgttcacatcagcattattgataatggcccaaaagtagaaacaatcctaatgtacatcaactaataaatggataaaaaatgtggtgtacctataaaatgaaatagatattattcagccatagaaaatatgaattttttttttaagacagtcttgctctgctgcctgctggagtgtggtggcacaatcacggctcactgcagcttcaacttcccaggctcaagcgatcctcccccgcctcagcctcccgagtagctggggccacaagcatgtacttccatgccctatttattttgtgtgtgtgtgtgtgtgtcggggagggaggggtaaagaatggggtttccctttgtttctcaggatagtctcaaactcctgggctcaagtgatcctcctgcctcagcctcccaaagtgttgggattacaggcatctgccactgtgcctggccaggaatgaaatattgatagatactatgacatggatgtaccttaaaaacattatgctagggctgggtacagtggctcagcctgggcaatatagtgagactcgtctctatgaaaaaaaatatatactttttaaaattacatttaaaaagctcccccccaaccccattatgctaaatgagagaagccaatcataaaacaatataaattatgtgattccatttatatgaaacatccagaatagggaaatctacagagacagaaaatagattagtggttgctaagggctgagggagtgggaattggagggaaatggggaatgactactaatgagtatggaatttctttttggcttgataaaaatgttcaaaaattgattgtggtaatggttataaaactatgaatatattaagaactactgcatcatacactaaatgagtatattgtattgtatgtgaattatatctcaataaacctgttacatgaaaaaaataacagtctctacaggttctatagatattaaaaggatagtaagaatattatgagcaatatcatgccaataaatttgacaacttcaataaaaatagacaaattccttgagacccaaattgcaagagctcactcaagaagaaatagataacctgcataaaccctgtatctttaaaaaaatgaattggtagtttaaaaaaatcttcctgcaaagaaaactccaggcccagacggctttattgataaactctacaacacatttaggggagaaataacaacatctccacacatacttttccactaatttaaagaggtggcagtacttctcaactcattctctaaggtcagcaagcattactctgacaccaaaaccaaataaagacattatgagaaaagaaaactatagtccaatatcctcatacatatggaatcaattttttttttttttgagacagagtctccctctgtcattcaagctggagtgcagcggcgtgataatagctcactgaggccttggacttctgggctcaagcgatcctcccaccatagcctcctgagtagctgggaacacaggcatgccaccacactcagttaatttttattgttttgctgagatggggtcttgctatgctgcccaggctggtctcgaattcctggcctcaagcagtcctcctgcttcagcctcccaaagtactgggaatacaggtgtgagccaacatgctcagacaatgcaaacattcttaacgtaattttagcaaattgaatctaacaaaatagaaaaatgataattcaccatgaccaagtgaggtttattctaggaatgcaagattggtttaatattcaaaaattaatgaatgtaatcaactatagcagactaaaaaagaaaaacattgatcatctcaatagatgcagtaaaagaatttaacaaaatccaacaccttttcatgattaacaatactcaataaactatgattacaatggaacttcctcaacctgataaagggcatctagggaaaacctaacatcataaaggtgagactggatgctatctccctaagagcaggaataacagtaggatgactaatcctaccacttctattcaactttgtactgaaggttttagtcagtgcaataaggctggagaaggagcaggagaaaaaggataacaagaaggaaggaaggatggggaaaggaacaacttaattaaaacactggcaaggtcgggggaggggccaaggtgaccaactagaagtagctgctgttggctgctcctatcaagaatgaaaacagcgagtgaatgttgcactttcaggctgaggtaaccaggttctctcattgggactgactaggcagttggcacaacccacggagagcgaggaaaagcagggtagtgcaacagccccacctgggagccgcacagggcaaggggagttcccacccccaatcaaggaaggcgatgagtgattgtggcaccctgcccaggaaaccatgcttcttccacagatctgtgcaacccgtggatcaggagattccccttgtgagcccaggccaacagggccttggatcccaagcacagagctgcccagatgctcagtggccactgaggttgcagccagcagcagcaggctggagattgcctaagacgaccaagttcccgggacagccaccatcactgcaggtccagtctgcccttttcccctgccagtgccggggagaataggtggtttggaccaggaggaattccccacagcacagcacagtggtagtggcagactgtggccagaccgcttctttaggtgggactcggatccattcctcctcactaggcgaggcctccctgcagaaatgtcagcaactccaggtaggggtttatgagcagaactgatctccctgggaaggagcccctgggggcaggggtgactatcgtcttcgtggttcagcagacttagtctttcctgcctgctggctctgaagggtctgggcagtccagaggagggggattcccttcagtgcagcacagctgctctgccaaggggcagtcagagtgcttccttaagcaggtccctgatcccgtgcctcctgactgagaccccccaccaggggttgccagacatcttatacaggaacgttcctgccggcatcaggtcagtgcttcctcccagaggacggagcaagcagccatctttgctgttctgcagcctccactggtaatacctccaggtgcgagagggacccaggcgagtagggtatggattcgaccgccaacaaatggcagcagccctacagaagaggggcctgactgttaaaaacaaacaaacagaaagcaacaacaacatcaacaaaaaaagaccccacaaaaaccccatccaaaggtcagcagcctcaaaaatcgaaggtagataaactgaggatgatgagaaagaatcaacacaaaaacggtgacaactcaaaaagccagagtgcctcttctccaaatgatcacaacacctctccagcaagggcacagaactgggctgaggctgaggctgagatggatgcactgacagaagtaggctttagaagctgggcagtaacaaacattgctgagcaaaagaagtaatgttctaacccaatgcaaagaagccaagaaccatgataaaacattataggagctgttaaccagaataacccgtttaaaaaggaacataaacaatgtgatggagctgaaaaacacaatgtgaaattcacaatgcaaccacaaatatcaatagctgaagagactaagcagaggaaagaatctcagagcttgaagactatcttgctgaaataagacaggcagacaaggtgagagaaaaaagaatgaaaaggaatgaacaaaacctctgagaactatgggattacataaaaataccgaacctacggctgattcaggtacctggaagagacggggagaacggaaccgtttcaagttggaaaacatacttcaggatatcatccaggagaacttccccaacctagcaatacaggccagaacttctccaacctagcaagacaggccaacattcaaattcaggaaatccagagaactccagtaaaatactccatgagaagatcaaccccaagacacataatcatcagattctccaaggtcgaaatgaaggaaaaaatgttaagggcagccagaaaggacaggtcacctacaaagagaagtccatcagactaacagtgcacctctcagtggaaaccctataagccagaagcaattgggagtcaatattcaacattctgttttttttttttttttttttttgagatggattcttgctctgtcacccaggctggagtgcagtggcatagtctcggctcactgcaacctccacctcctgggttcatgccattctcctgcctcagcctcccgagtagctaggactacaggcgcctgccaccatgcctggctaattttttgtatttttagtagagatggggtttcaccgtgttagccaggatggtctcgatcttctgacctcgtgatctgcccgcctcggcctcccaaagtgctgggattaccggcatgagccaccacgcccagctcaacattcttaaagaaaagaatttccaacccagaatttcctatctggccaaactaagcttcataagtgaaggagaaataaaatccttttcagacaagcaaatgctgagggaacttgtgaccaccttgcaagaactcctgaaggaagcactaagtatggaaaggaaaaactattaccagccactacaaaaacacactgaagtacacaaagcaatgacactatgaagcaactacaataacaagtctgcaaaataaccagctagcatcatgatgacaggatcaaatcacacataacaattttaaccttaaatgtaaatgggctaaatgccccaattaaaagacacagaatggcaagctggataaagaatcaagacccatcagtgtgctgtattcaggaggcccctctcatgtgcaaagacacacataggctcaaaataaagggatggaggaaaatttaccaagcaaatggaaagcaaaaaaaagcaggggttgcaatcctagtttctgacaaaacagactttaacaaagatcaaaaaagacaaacaagggctttacataatgctaaagggttcaattcaacaagagctaactatcctaaatatatatacacccaatacaggagcacccagatctataaaacaagttcttagagacctacaaagagacttatactctcacataataatagtgggagacattaacaccccacagtcaatgttacacagatcattgagacagaaaattaacaagtatatttaggacttgaactcagctctggatcaagtggacctgatagacatctacagaactctctacccaaaaacaacagaatatacattcttcttggtgccacatggcacatactctaaaattgatcacataactggaagtagaacactcctcagcaaatgcaaaagaactgaaattataacagtctctcagaccacaggacaatcaaattagaactcaagactaagaaactaactcaaaactacacaactacatgaaaattgaacaacctgctcctgaatgactcctcagtaaataatgaaattaaggcagaaatcaagaagttatttgatactatgagaacaaagagacaacataccagaatctctgggacacagctaaagcagtgttaagagggaaatggatagcactaaatgctcatatcaaaaagctagaaagatctcaaatcgacaccctaacatcacaactaaaagaactagagaaccaagagcaaacaaaccccaaagctagcagaatataagaaataaccaaggtcacagcagaactgcaggagatagagcacgaaaaacccttcaaaaaaatcaacgaatccaggagccagttttttgaaaagattaataaaatagaccactactagactaataaagaagaagaatcaaacagacacaaaaaaaatgataaaggggacatcaccactgatcccacagaaatacaaataaccatcagagaatactataaacatctctatgcaaatcaactagaaaatctagaagaaatggataaattcttggacacatacaccctcccaagactgaaccaggaagaagttgaatccctgaatagacccataaggagttctgatttggggcagtaataagcctaccatccaaggaaagcccaggaccagatggatttacagctgaattcagaggtaaaaagaggagctgataccatttcttctgcaactattccaaacaacagaaaaagagggactcctccctaactcattttatgaggccagctcattctgataccaaaatctggcagagatacaacaacaaaaaaagaaaacttcaggccaatatccctgaagaacattgatgtgaaaatcctcaataaaatactggcaaaccaaatccagcagcacatcaaaaagctcatctaccacgatcaagtcagcttcatgcccagtatgcaacactggttcaacatacacgaatcagtaaacgtaatccatcacataaacagaaccaatgacaaaaaccacatgattatctcaatagacacagaaaaggcctttgataaaattcaacatcccttcatgctaaaaactctcaataaactaggtattgatggaacatacctcaaaataataagggtgatttataacaaacccacagccaatatcacactgaatggacaaaagctggaagcatttcctttgaaaactggcacaagataggactccctctctcaccactcctattcaacatagtattggaagttctggccagggcaatcaggcaagagaaagaaataaagggtattcaaataggaagagagaaagtcaaattgtctttgtttgcatatgacataatcttctatctagaaaaccccatcgtctcagcccaaaagctacctaaactgataagcaacttcagcaaagtctcaggataaaaagtcaatgtgcaaaaatcacaagcattcctgtacaccaacaacagacaagcagagagccaaatcatgaatgaactcccatttacaactgctacaaagagaatacaatacctaggaatacagctaacaaggggagtgaaggacctcttcaaggagaactacaaaccactgctcaaggaaatcagagaggacacatacaaatggaaaaacactccatgctcccagataggaagaatcaatatcatgaaaatggccatactgcccaaagtaatttataaattcagtgctactcccattaaactaccattgacattcttcccagaattagaaaaaaactattttaaaattcaatatggaagcaaaaaagagcccgtacaagtcaagacaactgtaagcaaaaagaacaaagctggaggcatcacgctacctgacttcaaactatactacaaggttacagtgaccaaaacagcatggtactggtacaaaaacagacacatagaccaatggaacagaatagagaactcagaaataagaccgcacatctacagccatctgatctttgacaaagctgacaaaaacaagcaatggggaaaggattccctatttaataaatggtgctgggaaaactggctagccatatgcagaaaactgaaactggaacccttctttacaccttatacaaaaattaactcaagatggattaaagacttaaatgtaaaaccccaaactataaaaaacctagaagaaaatctaggcaataccattcaggacatggtacaggcaaaggtttcatgacaaaaatgtcaaaagcaattgccacaaaagcaaaaattgacaaatgggatctaattaaactaaagagcttctgcacagctaaagaaactatcatcagggtgaacagacaaccaacagaatgggagaaaatttttgcaatctatccatctgacaaaggcctaatatccagaatctacaaggaacttaaagaaatttacaagaaaaaaatcaaacaaccccattaaaaagtaagcaaaggacatgaacagacaattctcaaaagaagacatttatgtggccaacaaacgtatgaaaaaaagctcaagctcagtatcactgatcattagagaaatgcaaatcaaaaccacaatgagctaccatctcacaccagtcagaatggcaattattaaaaagtcaagaaacaacagatgctggcgaggctacagagaaataggaacgcttttacactgttggtgggaatgtacattaactcaatcattgtggaagacagtgtggtgattcctcaaagacctagcaccagaaataccatttgacccagcaatcccattactgggtatatacccaaaggaatataaatcattccattataaagatacatacacatgtacgtccactgcagcactattcacaatagcaaagacatagaatcaacccaaatgcccatcaatgatagaccggataaagaaaatgtggtacatatacaccatggaatactatactgccataaaaaggaatgagatcatgtcctttgcagggacatggatggagctggaagccatcatcctcatcaaactaacacaggaacagaaaaccaaatatcacatgttctcacttataagtgggaactgaacaatgtgaacacacagacacagggagggaacaacacaaactgggacctgtcgaaggcggggagggggagggagagcatcagggaaaatagctaatggatgctgggcttaatacctaggtgatgggttgatagatgcagcaaatcaccatggcacatacttacatatgtaacaaacttgcacatcctgcacatgtacctcagaacttaaaattaaaaaaaaaattggcaaaagatttgaacagataattcatccaaaaaaaatatgggtgggaaaaaaagcacatgaaaagatgctcaatatcattagacattaagaaaatataaattaaaaccacaatgcaatatcacctcgtatctattagaatgtctaatattagcaagactggccatatagagtgttggtgaggatgtgaacaactgaaactcatacacagtgcaggtggaaatgtaaatgatacaatttttttggaaaagagttggctgtttcttcaaaagttaaacattacatctgccatatgatccagacattccactcctaagtgcctactcaagagaaagacagcacacgtctatacacaaaattgtacacaagtgttcacagcaactttatctgtaatatcccccaactggaaacaaccaaatattcatcatcagatgaatggacaaacaaaattgtggcacgtccaaaccacggaaacactactcagcaatacaaaagaataaactactgatacaaatcataacatggataaaatgtaaaataatcatgccgagtaaaataagccagacagaaaaaggatacatactgtaggattctacttacataacattctagaaaatacaaactaatatataatgagagaaggcagattggcagtcgtctggggactagaggtgtgggagagaggcattacaaagggacaccaggaatctcaggaatctcatggcagtgatggatggatgtgttctctgtcttgaccgtggtgatggttgttgcataggtatatatgtatgtcaaaacgtacccagttgtacataaatatatgttcggtttacatatcagttataccccaataaacctgttaaaaaatgacatgctggctgggtgcagtggctcacgcctgtaatcccagcactttgggaggctgaggcaggcggatcacgaggtcaggagatcgagaccatcctggccaagatggtgaaaccctgtctctactaaaaatacaaaaaattagccgggcattgtggcacacacctgtagtcccagctacttgggagcctaaggcaggggaatcacttgaatctggaaggcggaggggttgcagtgagccgagatcatgccactgcactccagcctgggagacagagagagactccgtcttcacaaaaaaaaaaaaaaaaaaaaagacatgcttccctaggccgggtgtgatgatggctcacgcctgtagtcccagcactttgggaggctgagacgggcagattgcctgagctcaggagttcaaaaccaccttgggcaacatggtgaaagcccatgtctactgaaatacaaaaaagttagctgggcgtggtggtgcgtgcttgcaatcccagccactcgggaggctgaggcaggagaattgcttgggcccaggaggcagaggttgcagtgagccgagatcgcaccactgtactacagcttgggtgacagaatgagactccatctaaaaaaaaaaaaagacatgcttccctaaaggctgcatcttaggaaaataccttttagtagctttgctaactgaacatactatcttcattcattatctcccactgaatgaatccagattttaaaatgtcatctgagtattattgacatcaatttattgtaacactagatcctttatataatgaaaatcctcattcatctacattgatcaaaattaactaacaagctgacaaagctcctctttgcacaaacacaaacccagtaggaaagtcatcaaactaggaagtcaaatcagccttttctgtaatcacattgaaatccattaatacctgagtcagaggtaaagacaaatactgtacataaaaaatattatgagaaaaccacaaaagaattagagctatatgtacagcaaatgaatttatctatggaaatacattttagaatttattgtgaacttaattttttaggtatacacataattaaaaaggacaagtaacttctgagctgaaggtagaagttgaagttatatatacagttatgtactcatgggtaacacagaaagcagaatgcaaaataagaaatgttcacattctatatatatatatatatatatatatatagagagagagagagagagagagagagagagagagagggagggagagagagagagagatggagtctcgccctctccccaggctggagtgcagtggcgtgatcttagctcactgcaacgtccgcctctcgggttcaagcgattctcctgcctcagcctcctgagtagctgggattacaggcggcccaccaccacacccagctaatttttgtatttttagtagagatggggtttcaccatgttggccaggctgttctcgaactcctgacctcaggtgatatgcctgccttggcctccgaaagtgctgggattataggcatgagccaccatgcccggcctcaatttagatatttcataaactaaggccttattaacaatttctgacagaagaaaaatgcaacctttcttatctatgtaatctaaaaaggagagaggataacgaatgaagcccagagatgtggaagatcatgctctctgttgatgcaatcacatttggaatttagttcaatatatcagtcaaatccactcttatctccctgccactaccaggaaaaaacatctaaactctgataattaaaaataacatacttaccatgaaaattttccaaacacagtaaatagagaaaaagtaaccaagaaaattaaaatatttccccttgaaggttttggagtattctattctctcctgggggaaaacaaacacaaaacatagttttcagcaaaatataaatttatattcaacacaagtattcttccctctatgaatcactgttcaggctaagtcaaaaaaccatacattgtaataatattaaactaataacagtagttgtggccagcatttactgaatgcttgcttttagctagagactgggataaacatcttacatgcattatccacttaatcttcataacaattcttatgagatacgttctattatcttaattttacagatgagaaaattgaggctttgagaggttcgataacttgctcaaagtcacacagctggtgagtaggctcaggtttatctgtttccaaagcctatgttaacctctgtcctataaggttactcctgtaaagttatcctcaaaaagaattaaaagtttgtaatcttcactaacagattttgcacatttaaattatattttattttaggtgtacataggaaagttacttcttacagtttcgacacttattgacctggatcctttaaaatagggctaggccatccatggcagataggtgtctactgctcttataatattactaacttataaaggaataaaagtagctaccatctttatcccaggttagtaggaggtggtacgtgccaccttcctaaatgttgaaaagcctcttctgactatcccaccaattgctacttttgagagtgttccattaaggattttgctagtgacaggagcaatttcatgaagagtgaagatcccttatccctaatgcttcatggctgatatagaagctgtgaggtatctcttgcttggccacagagaaatctaaaaagccatttagtcttgttctctctttaataatattggtaaaaaccacacttcagtttccttgctctgtaccttggtagcatatagatcagctgtttccagaaaaagctgcctgcttaattcttccaaagcatccacttcctgttgaataagagtaagatctggcacagaatgggcatcaaggttttaatcacataggaattcaagaaatggcaatgagaaagcatatacttttggtttttcctacagtggattcccggagttgcctatattctcaatttcctgtttcatagccagcagcgctacttcagagcagctttcccaacctctgacgcaggtgtgtaaaagcttctccatcaagagcatcgccaccaaacaattaccactcagtttctcttaagcagctcaaacagatggtttcatttgttttttgatttaactagttagattaagtcaaatgtaatgttcaagattgtaaatagttacagaataataactataataaagcatagctttctcctacattatctgaatataatgttagaaaagggaactaatactttactgtgttctaatataggctaggatttacagacattaccttctttcttttcaaacattatcttcttttatatcttatcttcatgggattgtcttatgccatggtgttatccattttgcacataaggaaagtgaagctcagagagttaaataacttgctcaaagtcacacaattaattgatagagatgcaaagtcaaatcctcttttcctccaaagcctgctctttccattacactatgttattttccaagaactcaatcaggtagagttattattctcccatttagagaacaggggctcagggaggttaaataatcctgatatgtttgttaactcattactaacacagctcaaacccgtattattggcttttatgaacttttaagtaataaacatagtaaatacagccccttctaaaatagaagcacatacttcaatctaaatcctccctcctctctgatttttcccactattacccaaatcagtaagtgcccttcagttccttccttaatagtggctactactggcatggttcaagccaccaaacaatatggtttaactagttacatgtctgtctctcccatgattagagggtaagctccttgaggagaaaggctatactctactcatcattttatttcttagcactcagcctggaaataggagatacgaaataaatgtttcttggttaaataaatctaaattaatcctttttctttctcttccacaatcatcttgcctttctttgatcttattcttatcttcatttgacaccaggacataaatcataatttgtagcaagaatagacatccttctctaattgaggcaaaagggaatttgtatttccctgggacagagaaggaaacaggagtatgctatctcatgcttagttccccaaagttttgacctaatagcaccagagccacacagaaatttggttacataatttgggaagtagttcaacatcataaccaatcaggaaagaacagtttattaatctattaatcaaatctcctttatcctttcttttttattttgagacagggtctagctctgttgcctaggcaggagtgcagtggcgtgatctgggctcactcctacctcagcctcccaagttcaaacaatcctcccacctcagcctcctgagtagttgggattacaggcacatgccactgggcctggctaatttttgtattttttgtagagatgaggttttgtcatgttgccgaggcttgtcttgaactcctgggttcaagtgatctgcccacctcggccttgcaaagtgctgggattacagggatgagccactgcacccagcctccccttgattctttaaaccaaaatgtcactggagaagcagagctacttaaaatttgtttaggaatactaattactttagaaatgggccatttattttaggtagccattatgctttatggtggtttttcagagttgagaaatgtaatagtgtagtggaaagaactatgaagaggagaccacagttatgtttctagctttgccacaaaccaccgtgtgacttaacctctctgggtctattttctcatctgtaaaatggaaaggctgactttttaggaccacttcagctcaaagacaatgattttatgatattgtgcaggtgctggaaagatgactgtacacatggtatttcctaagcctagctcttaggagtttggactctgatgtagtcaggtaccttagaagggactatcccaacactactttttttcttttgctcttggtccagagttgagaaaaagaatcaagcagagggacaaaggatactttcacttcctgatgctgaagtggtaacactttttatcattccccagaaacctgatggtttgttatgcacttcccccttctggaacattgttctccgtgccattgccatcctgaaatgaaagaaaatataaagcctcagcaagcaagcatggaccctcacagtctagtcccatccattttccagtctcacaactgcctctcatgtactgagctgtttatgtaaggatactgattctggagtcctacttttctactacttacaactgaagggaaactatgtggaagcaatgtggcctgggtgaagaagcacagaatttgggctaggcaataaatttgaggactggctctgctatttggaagctgggaggtcttagagttttcatctcctcatctctggatggttgtgaagataaatgaaataatacatatgaattcatgttcatatgaggcgctatacatagtttaattactacagttaccatttaaagacaaaataaaacagctaacatacctggctgggtgtggtggctcactcctgtaatcccagcactttgggaggccgaggcaggtggatcacctgaggttgggagttcaagaccagcatgggcaacatggtgaaaccccatctctactaaaaatacaaaaattagctgggcgtggtgacccatgtctgtaatcccagctacttgggaggctgaggcaggagaatcgcttgaacctaggaggcagaggttgcagtgagctgagatcacaccactgcacgccagcccaggtgacagagtgagactccatctcaaaaacaaaacaaaaacaaacaaacaaaaaaaaccagctaacatacctaactaaaggaccaaatacagagtttggaacgcaatacatgttttcttccttctttttcaaaggcagacaaaaggaaaaaaaaatagcaaaattgcataaacctgtccccttctaaaatatcagtctctaagtccaataccctcaccttctgcaatctgtcctacaggtgaataaatcaacaggaaacctaccactcctggtcctctcagtctgtggaggaccgactagtacagtggtagctgctggcatgtcccagctcaccacaaaggtatcaacagggtcctagtgaggatcaaaataaaatatcatttgtacataattgatttaaagggtttaatgggccaaggcctacaggcataaaatgaactaggatgagtctaataaaaatagagtagcaggaccaaagaaaaatgtaactcaaggtggatatttttgggaggcaaaagataaaaatggtgaagagcaagcagcagcattggtatttatgcctgggactaatacaaatagtaccaatggtaccaaagatcaaatgatatttctatgggtgaaattttttgagccattagctaaaatgatattaacaagaaagaatgtcagccatgttgacttaactgtttccttttgaaaatgacctttgcctggatactgagtgaatgaaacacagctcttttagctctttctgcctttcttctaactacacatctactatcactcaccattttgggaagatgtaataaacaaccaagaagaggctcagacctagggagattctgacttgtaagattaaggcttagtaattctaggtttttatattttcatagttgaaaaagctagaacacatatacaaagaaggcaagggttctattccactcatttaatagttcatttcagcttaacatgcaggattaaaagaggcagttgtgagagaggaagcacagagctcatttctattgtccttattttcagtgtctacaacaaacactaatgactggctgtggagtggaatcgattgaatatgtaaaggtgattgacactgtgctgtggtctcataataggcaaagaagtgtaatcactagaagtgaaagttagaggcacatagacaagcatggccttgttttaaacaattcacttttactttcaattgtatcaagaatctattaattctaaaccaattttgctcttatcaaataagttgtagatgaaaaagaaatgatcatatatttaagaaggtaacaatattaaaccttccgaagcgtgaataggaatgaaaaaaccacccaaccatatgaggtactatagaattagatcaccttcatcttcaacttttctttactatcatcatcactattgcctctttataacaagggtagcttacaaggaattatctatttgttattagcccaatgtcatttaaaagttcctaatatggaaaaacatatgcacttggctgaggtttggtagtagtgcacaacagaagaagctaaaaaatgtctactgaggtttaaatgtcagtcaactattttctggtctctgttgtttctagtaggaagtcagccattacttttttttagttaaactttttgaaataattgtagattcataatgtagttttgagaaaaaatgcagagattccatgtaccctttacccagatttcctcaactgaaatatcttgcaaaactctagtacaaccaggatactgacattgatagagtcacaatacgggacatttccatcactacaaggatctttcagggtgcacctgtacagcttacctccctcccacctccaattccttaattctggcaaccacgaatctgttctccatttctgtaattttatcatttcaaaaatgtatatataactagaatcatacggtatatattctttggggattctttttcactcagcgtaattttcataaacattcaagtacagtttttttgtgtgaatataaatcttcatttctctggataaatgcccaggagtgcaattgttggggtgtggtaacggcatgtttagcttttaaagaaagagctaaactgtgttccagagggactgtaccattctacatggatgccagcaacgtatgagtgatccagttgctctgcattcttattagtatttggtgttgtcactaatttttattttagctattctgataggtgtgtagtgattatctcgatgtagttttaatggcatgtccataatggctaacaatgttgaacaccttttcatgtggttatgtgccatttgcatatcctctacaataaaatgttcatcatttttgcttattttctaactgcattttttttaaatgtaagctttgaatgttttttattctagatactagtgctttctcaaataagtggcttgcaaatattttctcccagtgggtagcttatcttttcatcctcttaacagtattttttttttttttttttttaagaaggagtcttgctctgtcacccaggctagagtacagtggctccatcttggctcactgcaacctctgcctcccaggttcaagccattttcctgcctcagcctcccgagtagttgggattacaggtgcccgccaccacgcctggctaattattgtatttttagtagagacggggtttcaccatcttggccaggctggtcatgaactcctgaccttgtgatccacccaccctggcctcccaaagtgctgggattacaggcgtgagccaccgcaccgggccttaacagtcttttacagagcgaaagtgttaaattttgatggagcccaatttatccattttttcctttcatggattttatttttggtatcaagtaaagaactttttgtgtagcccttgattccaaagattctttttttttttttctgaaagttttatagttttacattttagtctattatctgttttaattttttttttttgagacggagtctcgctctgttgcccaggctggagggcaatggcggatctcggctcactgcaacctccacctcctgggttcagcaattctcctgcctcagcctctccagtagctgggattacaggtgcccgccaccacaccgggctaattttttgtatttttagtagagacggggtttcaccatgttcgccggtctagtcttgaactcctgaccttaagtgatccgtccgccttggcttcccaaagtgctgggattacaggcatgagccaccacgcccggcgtgttttaattttatataaggtgtaagacttagatttagattcattttttaaacctatggacgcctaattgctctagcaccatttggtgaaaggttatctttcctccactgaactgcttttgcatctttgtcaaaaattagctgggtgtatttgtgtcagtatttcttttcttttctttttttttttttttgagacagagttttgctctgtcacccaggctggagggcaggggagcaatctcagctcactgcaacctctgcctcctggattcaaacaattcttctgtctcaacctcccaagtagctgggactacaggcgcatgccaccatgtccagctaatttttgtatttttagtagagacggggtttcgccatattggtcaggatggtctcaaactcctgacctcaggtgatctacctgcctcagcctcccaaagtgctgggattacagacgtgagccactgtgcctggccatgtgtcggtatttctgggttctcttttctgttccagtgatctatgtctaccagtaccacagtcttgattactgtagctatataatatgtttaaagatcaggtagaggaattcctctcatactgttctttttaaaaattgtattaactattctagttattttgcctttctgtacaaattttagaataattttgtgtatatctacaaataaatcttgctgggattttgaaatgaataacattaaatttgtataccaatttggggagaattaacatcattactattcaagtcttccaatctattaacatggtttatttatatcttatttgatttttttcattagttttataattttcagcaaacaagtcctatatacatgttttgttagacttctatgtaagtatttcattttgtgagtgattgtaagtagtgtatttaaacatttgatgttcatatgtccgttgctagcttatagaaagacaattgatttaaaaaaattggattttcaagatggggtcttgttactttgctctcaggctgcactcaaactcctgggctcaaacaatcctctcgctttagcctcttgagtagctggtcaagcgcattcaccactgctcctggctacaactgatttttgtatgttcatttggtattctacaatgttgttgaataaccattacttttttttttcccattgttgccctgtatgtatcattttccccttgttgctttcaagattttctctttacttttgccttttagcagtttcactatatatacacataggtgtagttttcttatgttttgggctggtatttctttcaatgctttttctgcccctttccttttctttagaactccaatcacaagaatgttggactgcttgatattgtctcctactgagacttttgttgagttttcttcaatatttttttaaaaaaatatttactatttttttcttctttttgagacagagtctcgctctgtcacctggggtggggtgcagaggcgtgactgcagctcactgcaacttccgcctcccaggttcaagccattctcctgcctccatctcctgagtagctgggactacaggttcccaccaccacgcccagctaattttttttgtatttttggtagagacggggtttcgccatgttggccaggcctcaagtgatccgcctgccttggcctcccaaagtgctgggattacctggccatttttcttcaatcttttatctattcttcagattaaataatttctattactctatctcaatttttatttttattttatgttttgagacagtctcgctctgtcacccaagctggagtgcagtggcatgatctcagctcactacaaccttgcctcctgggttcaagtgattctcctacctcagcttcccaagtagctggcactacaggcacgtgaaagcatggccagctaagttttgtatttttggtagagacagggtttcactatgttggccaggctggtctctaactcctgatctcaggtgtccaaccacctcggcctcccaaagtgctgggattacaggcgtgagccaccatgcccagcctgaatttttatggatctgattcttctgtcatctcaattctcctgttaagcccacctagtaaaatttttatttctgttactgtagttttcagtctttggatttctattttgttgttttttaaaagtttccatttctttgttgggattctctcttttcacttgtatcatgctttccttcacttttttgaatatatttgtaatggttactttcaagtctttgttaaatgtgtaatctggatccacttggagttagtatctattggctgctttttatcttgaacattggtcacatcgtcttgtttctttacatgtctagcaagttttggttgaaggtaatatgttgtagtgactttggaatctgttttgtttttctgagaattgttaatttttttggtactagtaagcagttaatttacttaaactgtgaaatctgtcatacctgcagcagctaatgtttctgctcagtttcttggtttctagcttctcctttttagcctaactccctgatattctctgctgagcttgagcttgtgtagggtagtggtagtctggacaaattctatagtcatattttagggcttatcctctctgtggatcttttgcttctagggatctctcctaaattttcaactgctttgccagtcctgagatctaccctctgacacctcaagccagaaaagctttcactttctgtcatccaaactgtgtgttcaacctgcacatagctcagaaaatgcactcaatcaaaggcacagcaaccttgcaaatcgcaccaagaagcagttcagtatatcaagcatagactctcttccagtttctgcctatttttctcaggctctttggtgtttaccgtggaaatacattatttaatgatgacacagagatttgggaagggtttatactgagattttggatattagtccttctgcatttccctcatttccaaaatttcccctttaaatgttcagttactcagctgatttaaactcttaccaatctgtacacttgagtgggtgctggcagggggggtggtggctaaggggcacttccaggcaagaaagctatcaacttgcaatagttacctgatgctcttctcaaatttctacctgcctctgctcattttccagtaacttcaaatacttgcttttaatattttttccagtttttatgattttctgtagaaagaattgcttaaattctttccactgtcatttctggaagtttcctctattgagaatggctgtgggtattgctgaaatttcactagtgaatatatttcttcctcctatctctacaaaatttcaaagaggtcctagaaaactaattcaaggtagaggttaacattttttccttcactgttccaaacaggaagacgtatgcctctttcctcctcccattttaaaccattaacttttttgtacataacaaatgttacttttcttgtatgtcatctcactatggccctctactgttaaggtgaaagatggttttctggtcactactcctccccaactatgaatgtttgcaaaaacagtttttcttttttattaaaaaaaattttattttgtaaaaccacttgtaaacaacaaaaacagtttttctatattgtggtaaatggcaagggcattatatgaatcccaagggccccagtgttgtcatgtttgctgtctatctgctctgttagttccactgggtaaaggactgtggtaacggggtcacgttgggaggctgattcttctgtgagccactcaaattaataaaacttactgtcggaccacaaaccattcctgatcctgaccagacaatgcattataggggaaatgggctatagtatgtatagatcagagtcaattccttagcactattagtatgaaatggcttaaaagtatgtatacacacttgacaagggtcatgacttcactttttttttttttgagacagagtctcgttctgcccccaggctggagtgcagtggtgtaatctcggctcactgcaacctctgcctcccgggttcaagcgattttcctgcctcagcctcccaagtagctgggattacaggcatgcaccactatgcccagataatttttgtatttttactagagatggggttttgccatgttggccaggctggtcttgaactcatgacctcagcctctcaaagcgttagggttacaggcatgagtacccggtcatgacttcacttttatatattcatttctttatatgaataaaagaaatacagtgagaaagagaatagccttgggaatcaaaatagtattgtttacataaatctttcacttttgaataatcttgctctactttttaaaatctgcatttatatacactcatgtaaaataaacaataaatgtaaataaaataaattatacacgtgtctaccttcaatagcctagtaaagacatgcagaaatagagacaaataattagtcagtgaacctgagccttcatcattctttttttttttcttttttgagacggagtctcactccatcacccaggctggagtgcagtggcgcgatctgggcttaccgcaagctccgcctcctgggttcacaccattctcctgcctcagcctcccgagtagctgggactacaggtgcccaccaccacgcccggctacttttttgtatctttagtagagatggggtttcaccgtattagccaggatggtcttgatctcctgaccttgtgatctgcccgactcggcctcccaaagtgctgggattacaggcgtgagccactgctcctggcctttatgtctaatgttatctcttacattaaggcttctttaacttgactatgggtcttactacagaaaagtgttgaaggaggaaatatgaaatgtgaaaatactcatgcaattcaaaacctgttaccatttacttatgggtaataataactttaataaagagagtagactaataagcttcatgaaggtaagaaatgattatcttgttcatcattctatccctagcatctagtacagtgcctggcgtaaactaggttttctaaaattattaagtgaatgaatctatgaatgaataaatgaaggcaaagcatgaaaagcaaatgattgtactgtagagactattaataatttcagtagttgtccttagctatatgtgggtcattgttctaagggctctaacttgtttttctaagtcttaactcattattattacctctattttacaaatgaggcacaaagacataaagtaactagttcaaggtcacaccattaagttttagatcaaggattcaaattcatacacagtctgatttcagagcctatgcttttatacactgtgatatagatttctatgaaatcccaccttgaaaatacacattttaaaagtactttttaaataacaaagatgatatagaggacttaaatgattttaagtagttggaacgaaggaagttgagatctaagtcagatatgtaaaagattgtaaaaaattaaggaaaatagacttaaaaaaattcaggacaataaggctgggcatggtggctcacgcctgtaatcccagcactttgggaggccaaggtgggcagatcacttgaggtcaggagtttgagaccagcctggtccaacatggtgaaaccccgtctctaccaaaaatacaaaaataagctgggtgtggtggtgcgcacctataatcccagatactcgggaggctgaggcaggagaattgcttaaacctgggaggtggaggctgcagtgagctgaaatcacgtcactgcactccagcctgggcaacagagtgagactccgtcttaaaaaaaaaaaaaaaaaacacaatagacaatattccattctttgaatacaaaaattatacaccagtccatgagcatgggatatctttccatttatttgtgtagacttcaatttcttctattaatgttgtatagttttcagtgtccaggtctttcttcccccttggtcaaatttatccctaagtattttttcttgtagctattttaagtgggatggttctcttgatttcatttttggaatgttcattgaacattagtattgttaaaacatccatactacctaaagcaatctatagatttaatgtaattcctatcaaaattccaacgtcatttttcatagaaatagaaaaaataatcctaaaatacacatggaaccacaaaaaactgaattgccaaggcaatcatgaataaaagaacaaagctggaggcatcatactatcttatttcatattatactacaaagcaatagtaattaaaacagcatgatacaagcataagcacaaactcattgaccaagggaacagaataaagaacccagaaataaacccacacatgtatggtcaattgatttttgacaagggtgccacatgtacacactgcgaaaaggacggtcttttcactaaacggtgatgggaaaactgaatatccatctgcagaagaatgaatttggacccttctctcacttaatatataaagattaactcaaaatggactaaagacttaagcctggaaactataaaactagaagaaaacagggaaaaactacacaaatcatgctctgagcaataactttttagatttaacccccaaagtgcaggcaattaaagcaaaaatagacaaatgggattacatcaaaataaaaagcttctgcacaacaaagaaaacaattaacagagtgaagagacaacctatggactgggagaaaatatctgcaagccatatgtctgataaggggttagtatacaaaatacataaggacctcaaacaattctacagaaagaaaacaaataacctgatttttaaatgggcaaggaacctgaatagacatttctcaaaagaaggcatacacatgaccaacagatatatcaaacaatgtttaacatactagccattaaggaattgcaaactaagacacaatgagatatcacctcatacctgtcagaatgactactatcaaaggggcaaaagataaagaacattggtgtggatgctgagaaaaggaaaccctattacattgttggtggaaatataaattagcacaaccctatggaaaatagtgtggaggttcctaaaaaaactgaaaatggaattgccatatgatccagcaatcccacttcttagtatttacccaaaagatctgaaatcagtaaaatgtcaaagagatatctgtacacctatgttcactgcagtattatttacaatagccaagttatggtatcaatctatatgtgcagcaacagaaaaatggataaaaaagatatggcatacatgtacaacagaatactattcagccttaaggaaggaaattctttcatttgtgacaacttgaatgtaactggagagcactatgctagcaaaatgagttggacacagaaagacaaatactgcatgttctcacttatatgtggaatctaaaacagtgaactcaacagaagcagagggtagaatgatggttaccagaggctggatgggtgggaggaatggagagatgatggtcaaagggtacaaagcttcagttagacaaggaggaataaggttttttttctttgcaacatactgtacagcatgatgaatataataaataataatgtattgcacatttcaaaatcactgagagtaaatttcaaatgttttcaccacaaaaaaataaacatgtgaggtgatagatatgttaattagcttgatttaattattccactttgtatgccacaaatacatacaaccataatttgtcaatttacaatttaaaaaattaaacaaaaaaattctaataatttatctaaggagaatgatctaaattcaagaaatgagattgaattttctttcacacaaaacactaaatctttttaaaaaaattttttatatttttaattttattgttattttaaaggggtggggtctcactatgttacccaggctagtctcgaacttctgggctcaaatgatccccccgtcgtggcctcccaaagtgctgggatcacaggtgtgagccactgtgtccagccaacactaaatctggtactttaccttatagtaaaaatgaataagataaaattccctgccagcaccaattcacagtcaaattttcttgttgagaaattgtaagagtccaaatgtattacagtgttgatatcttaccttttctttttgcttatgatcatatccatggtttgcagcagtcgccgttccagggctagaatatccgtgtcagtcacattcctacaaaaagcacaaactgctagcaaaatgttttggggtcccactcttgggcatgatacagggtatctggagacaaacatagacttcaactgttacctactacttttttctagaaaatagtaaaatgaccataataaactaaaatgcctttgctctcatttcttatagctaatcctctgggatctcagggaaatggaattcacccagctctcttacagtttttcttagctttgatccagttacatttatatatatatataaaatatatatttaaatatttttattttattttttattatactttaagttctcggatacatgtgtagaacatgcaggtttgttacataggtatacacgtgccatgatggtttgctgcacccatcaacccgtcatttatttatgaaagagtctagctctgtcgccgaggctggagtgcagtggcatgatctcagctcagtgacatttaggatgtatgtttaagcacacttttaacttggcattgtcttctactgttctgttaatatctaggaggggagctgaactgctgaagttggagttggtttatactgctggtcactagaaatgtgcctttaaaaaagtgggaggggagtgtcagattgaaatttgccatttaaaaaataaatgaatgtaggacaaataataaaggcaagccgtacaagtgataatacttatttagaaagatttccaggtcaatgcccacagggacagaggaagagaagaataaaaagacagtgtcatagatctaatatataatcttaaagatggtggcataatatgacatatgtattcaagaagtaatggggcaaaaaagaaaggatgcaaagcgctctgttacctgaggaagtaagacatgtaagtgtatgggcagttgacagcaccaaatccagaaagaagagccatgagagtcactccaatcacaccaacccggctgatgagctgttctatggataagatccctaaaaacatcaaggcacattaatgccaggtaatatagacaaaatggctctcatctgtactgcaaaaggaaacattatttaaaacattaaccattacacataactaactcatacaagccaacttttaattattaatgtgtagatgatttataataaatatactaaaagtttactgattttcctcctgtcccatatgcttcagagtgatctcttttattgggtgatagcagtaaaataataacaacaataattataaataacaatcattgactgtttactcttggtagcatgaatgctaacaaagcaaagtacttttagtaaaagcatcggccaaaaaaaaaaaaaactaagaaagtaaatctgctggaaaagtataaatagcaggaactactttgtgctaattatctttgatatatatgtatttcccctaaggtgatactcttttgcttttgtcttattcttttttgcatccaataaacacagaattcatctaataaaaggactaaacttatagatgaatgagtaattcaaaggcaaacacatcagtttcggattataaattgtatcctaattatcaattgtttcatatcacgtgagaatgctgaaaatcaacttagcagttaaaataaatactgctggttgatgtatttgggataaatgagagaaagcaatgctgaagaataactcagtaagtttggcattgcagaaaaagaatggttttaactggttttcactttctatttctaggatagaattcactacagccatccactcctatggtcaaatgccagagctataattcaggaattctgtcagcttcaaaactgaaaattccaatattccttttctgactactggcctccattcctagtctttctatttccactacactcgttttagaggtcagtgcaacctctggtcttctgcttctccattcttcacctagcttggactccaggcttgctggcttcaaattctctcaccaggagcctcaatctcctactatcttccttctgaagcgctaatcctacaaattcccaactctggatcagtctaacactctgccttccctgtgcccatgttttgctgcctcaaattgctagaatgcgtactgattttggagccattacaaatgtatggtctccagtcctaagagagctctcacactattgactaatccttatcttgcccttggtcagccatctctctccattgtcttcggcagttactctttatttttcctacctttgtccttctcctttgccaatgtccttattataaaagacatagctattagccataaactaccttcactctacactatggtcatgaattttctcctggttgcaaaattcaacattttccaatctttgttttatgggctgttttataacattgaatatacatctgcaatcatcctcccaacttgtctcccttagaacaaagtagcatccaaagctgacttctccacttgtgcttctgatcttctctgggccctgggaactgtctcatccttatatgtgagttctgggatattgctagtgataatcttggtgctatttgtttttggttttctgccaggggggtaagcaaagccagcttgcccctacgccaccatcttggaactagcagtcaccatacttttgattgtattcaatcccttccacctctttcagagtcttgttccatcatctgtctcctctctcttgtatattcaatatttccttctttgctagttctttctctttagtttcaattctcttttctaagagaaattctgttcttggcttcgagtttacgtctagttaccaacccccatctatttcctccttaatagccaggcttcttaaaagaagtttatagttattgtcaccttttcttcacctccagttcattccttaactgactgcaatccagctttcttcccattcttctttattgaatgaaattactttcactagtaattgtaatggcaataggtaatattcaccaagcacctgctatgactaggcactgttctaagcatttcacatgttctaattcatttaaccctcataacaatcctatgaggtagatattattgaaaacctaattttacagatgaagaaatggaggcacagagaggttaagtaacttagttaaggccacacagataaaaggggcagagtcaggattcaagtgcagtctagctccagagtctgggctttaaccactacgacactatggtaataagttttcccctggttgcaaaattcaacattttccaatccttgtttcattggctcttttatgacattgaatcatttttgtttaaaattattttatcttcttggcttccacaacaccatttccctaggttttcccttttacttctctaattgctttttcttggtcacttcttgctctgtctggaccagagttctcactttcatttcagtatacacattttttgcttaggtgatctcaccaatttccccagcttcacctaatggcatttagttgatgatttctagttgtttagattcctggagtcatctctatgaggactgatacatgtacaccttttccctaagctcctgatttgtacatccaattgcttatttaacatcacctggatatgcataagtaactcaaattcagcatataccaaactaaaattatctttcccctcaacttgttccttcctctgcattacctgtcttagaaaatgacataatcaccctaacaataaaatctatacactatacgattactttccattctatctcttgcctttccttgaatacaccaaggtctttctgcctcagggctttacatgatgtctcctgtgccttcttgctgggtcttcctttggtcttgtcctttaaatctcagcttaaatatccctgtctcagaaagggtggatctaactgtttgcactacattatcggcatttttctctatcacagcaacctgttcactccttgatgacaatgatcacaattggcaattatttatttatatatttacctctttattgtctagttccacccacaagactatcaatttcaggggggcagaaaccaagtttgtttcgtttgtggtttatttccagtgcttaatttatataaagtggatgctcaataaatatttgtgtaatgctgaatgaacgaataaatcctcacctaaattctgttattctacttgccgtatacctcttgaatttgcaacccctttacaagaagacatcatttcttattgatctttgttttccttactgcttggcacatatgaggtgttcaacaaatgtttgttgactataatatcactcagtaacataaaaaatccaagagattaatatgggctattaaatttgaaaaactgaaaaaattccccctctacctttattccttttaacatggtgtctttgtccttttattacatatctttttctggtttaaagtactttgtagatactatttacttaatctcagcatttctatgaagtaggagtcagtcatcattatccccatttagcagttaatacatggaaagtcagatgaataaggagactagcagaagatcatctcacctttgccacctgctcacacagattccttacagtcttttgtaatctctcttactctttcccactaaggacattccaaggttggttcagacaccgcacaagaagtacttttacagattatctttttttcattttacataaggattggtcttatctttttttttttttttttgagagtctcgctctgtcgcccaggctggaggggagtggcacgatctcggctcactgcaacctcagcctcctgggtttaagcaattcttgtgtctccggcctccggggagtagctgggattacaggcatgcaccaccatgcctggctaatttttctatttttagtacagatggggttttgccatgttggccaggctggtctctaactcctggcctcaagtgatatccctgccttggcctcccaaagtgctgggattataggggtgagccaacctgcccagcccatttttttgtggtcaccacagcaataaacaaccatactggttgttgggacagtcctgggaaagctctaagaaggcagtgtaaggctggttgcttctcagctactacctaaacttttcttcctccttacttatcttaaagggttaaataaattaagatacctgaacattcaggcataaaactgtaatgcctattggagtacaatggaaagaataaaactgaaactatctccctagctttctccctcagtgtccttttcagggtaatcccatagaatttagaaaaaggggtggatgaaaggacaatagatacaatggccttcatcttccctctggtgcggcctggctgcactggtcatgtgagctgaatgcacacaggagaaagctggagaaaggtgtcagagtcgggtctttgtagtgcatgtgagactgtatttgccctgtcagcagccctgggggccttttctaactcttctctctgacttctaccgtcacagataaatgtgtctgtctgtgggtttctttgaaataggtttatatgagaactatactaccaggactctttagtgcaagtcgttccctttgttgaccattgacataggcatgctgatcacattagcatttcctaaattcctatccagagtgttaaagtagtaaactcatctaccactttggagagactcaattttcttccatccactgattcaaagaacacgtattaaacacttgttatgtgtcagtttccacactaggcactggggatacaaagacaaataacatggagttttctgacctcagggagcccataggttgatgaggaagttagaaaaggaaacatgaaattttaagttttatagatgatatagataccttgagatggtagcaattaatatctcctaatgatggccaggaaaatcttcctaaaggaattgacaagagttgaatctagaaaggataaataggcattttctaggtagacagggttggtgaaggattgtccaggctgatagaacagctctagaaacttgaggctgggtgtggtggctcatacttgtaatcccagcactttgggaagctgaggtgggttgatcccctgagctcaggagttcgagaccatcctgagcaacgtggagaaaccccatctctatgaaaaaataccaaaattagccgggtatggtggcatgcgcccatagtccccgttactcaggaggctgaggtaggaggatcacttgagcctgggagtcggaggttgcagtgagccaagatcatgccactgcactccagcctgggtgagagtgagacctgtctcaaaaagaaaaaaaaaaaaagaaacttgaaataatttcacaggactggagaatgcaacatgtatagagagcagcagccaggtcatgaaaggtctcatacgccacctaagagtttgaatgcttttggcaggctggtgttatgttaagttttccggcctttaacgttatttgaaattttgaaagttattcttattttaaaaatacacaactatttatggtattgcatatgcttttcaaaactgcatatctcctctgatcttactgcaggagagtctcataacctctctcccgaaattcctgctataggcaatcagtatacatggaagggtgtgtgggaggtatggcagattctataatagacactggctcattcaacattaattccaatatccttttccagcatttgttttggtactacagagtttagaaagccaaaagccccttctcagacttccttgaggccaaggttttaaatattacctaggtttcaccaaaaaacccggcccatgtgaggcctcagatgcagaaatgaacaatgtaggggtggtgatagcacttaggagctcaaacagctgggactgaggtccctgatgtcatagaccctgagtggcaggtgataacttcagtgaggttttctagtttagtattgtggcatagttgggtatttctcttcactatatagcagttaagctttgcatccctactttcctagaaagtctataaattgcctgatactgtataattaatcactttctgctttaaattagttacaggagattctgttttctgcaataagaagcctagtaataggtacggcaggatggtgaataaagaggtatatatatatagatttttttaaaaaggttccagcatgaaacctgtagtatatttattacagatgggctctctaatctttttagatagattctctaatctttttagatagattcatacatacttctgaaatagttctggaaggacttgttagctgaggtacttttgttcattgtttttagcttaaaaattagggctctgccaaatttcttgttttaaaataaactttttttgttagaggggagacaccgattcttggaaagcttttctttatctactaattgtgggtgttttatgtcacctttcctcaaatacatatgcttccctaatgtatctttatcatcacttaagcagtggccgtttaccttttgggtcacagacccaaatctgctacccaaatctgataaaagtttattgataccttacctccaaatacacatacaaatatattcctgtagttccatatacaatatgagttagacaccgttctctttccttataccctttaagtatattcagtaaatgaaggtcaaaaattcctactctagaatgacagaagtgaggtccaaaaccagcattagttatctcttagaatgaaggagaaaatgtggttcaaaatcagacatttttcagagaaatagcttgctatcctcctcaatcagaaaaatttttttccaaatcccaagaacctgtgaattaataaattatttccccaaatacattttttccccaagaaatttaattaattgtttttgaaatcagaaaattaaacaaatcgtctccccccacttcctctgccctcctatatatactcaccatgttttgggctgagaatgggaaagggatctcctagtttccagaagaaatacataaaggtcagccataagagacaggaaaaaagcagtcgttgtttatgcactgagacagaggagacaaaactgttaggaaaaacagatataggttaaagagcttgctctatttaaaaatataagataatgctaactaatatttggctgctaattcacttggcaaatgactgatgaacagcataatttttagtgaaagcatccttaccatcgtaagagaaatttagctgaatttaaggtgtgggatgaactaaaggagacattattaataggtagaaaaataaagctgtggcagaacaaataacctaatcattcattcaatatttattttgtgccaattcattcaatatttattttatatttatttttaagatgttgtgtgtgaggtatcctcaaatagcggtagatactgaaagttaatgtagaaatgaagctatccacaatttaagtcccctcaaatactcatctcaatctatatgctgactgagagggtaaaatacttacgtagtcggatattgctcacaataaaatagccaatgtaaaaaggcaccatgaaaaccaggatcagcagaattacacacaggttcattttccagtgaaaataacgggagctgaaataaatgtcaaagactgtcactgggaggaagagagggcagcaactttctttctctttagtcttccaaagggtccttttgctctttggactcaatattgaatatatcctatctaatcagcctactaggctcttaaaatctactcatttgtagagattaaaaaatacaaatttttgaaaggtatatatgaccatcttaacatcttaagaatttcatatattaaaataagaatgtttatgtttttgatatattcataggcaacatataccattaacatgtatcaacatatgccattgctggtagaatgactattgttttacccacccctaggaatctcattccaatgtaagaattaaaggaaaataaatgttaacagtaatatatgttatactcaaaaatatttcttttgtactcttgatataaacacctgatttgcatgaattacttttattagtttataagatgtacttcatttattaaaactttttgttagcactttttataacagttttaatgagatataatttacccatttaaagtgtacaattcaatggtttttgtatactcaagagttgtgcaaccatcacctaaatcaattttagaacattttcattacgccataaagaaaccctgtacccattagcagtcactccctgtttctccccaatctcctcagctctaggaaaccaccaatatactttctgtttctaggaaaccaccaatatgtaatcttttgtgactggcttcttttacttaccataatgtttgcaaggttcatccatgttgtagtatctatcaataattccttttatggttgaacaatattcatcccattatatggatatattatattttgtttctgcattcattaattgaggacatttgggttgtttttagctattataaatagagacgctaggaatgtgtgtgtatacattctggtgtggacgtatgttttcatttctctttaggtagaaatggagtggaattgttgggtcatatgataaatctatatttaatcttttaggcactcccactgtttcccaatgtggctgcatcattttacattttcctcaggagtgtatgagagttccagtttctcctcagcctcgccaacacttgttattttctgtttttttttttggttatagccattttagttggtgtgaagtggtatctcattgtggttttgatttgcatttccttgatggctaatggtattgggcatctattcatatgtgcttactggccatttgtatatcatctctggagaaatgcctattcagatcctttattcattttttaattgtattatatgattaaactataagaattctttatatattctagatacgagtcccagtccattatcagataggtaatttataaaaattttctcttgtttttggaatgttggttcactttcttgatggtgtcctttgtatttactgattttaaacttacttaagccttgtttcaaaaaaggcctaagtggttaaatggcttacaaagataaataaaatacaggatgatgaaatgaactataaggaaatatgaacaacaatggtaacaggtaaaatattgggccaagcctgatggctattataaaacagaattctagaaagttgctatgggtaggtcataaatttagctttaagttttctaatggtcaatgtgaaataaaaaatttgatcagttagataaaatcatcatgtctgtaagaaaataaaaattaattcctcaaaggaagcataattatcatttattgttactgaattattaacaagattacaatgaaatttcttcaaagatttcataaagaaaatgcaaaggcaattaacagtgtcatcaacaacatcctttcaagagaaatatgtttcagagggctgtttcttattgttccttccttagtacagatggcaggcatcacgaaacaaagagccattcagtaaaagctaccctacagggagtgaataccatttagactagatacattgacagctttttgctcctctaggttaacaactactttagaacatttagagaaagaaacaagctggacatcctccaggcaatactacatagtatttcagctaagcttctgaaagattttgggaagcagtgggtttgaaataacaagtgcaactttaattggcagtatggactgcctattaaaagtgaaccacatgttttaactagtcttttgagctgagagtaaagtgatattctcttgaaaaaactaagcatcccaacaagattacatatttgaataggaagtcatatgatctctgctcaaaggtgagtcaaaggaatattctggccaagattctcttttcaaaacgattctgagtccagtcaatggacagttatacatcatcaaggttcatatttgtgttccataattgggtgaaacattagcatgaaaaaacaggtataactgaagatatgtctcagacccaatcctctatatagcacacaaagaaaaaccagattttagcaatgctacttcttatcctctttaactaattaagaaatttaggaaacatacaccatagtatgacagatgtttcttactatacgggttattaactataagttaaaagttgggggacatcatctaccaaaaacagtaaatatagctttagaatatctgaatcctctgtatcaatatttagatgagtagctggcaaactatggcctcacagccacctgcttttacaaattaagtttattggagcatggccatgctcgtttgtttatatattgcctatgactgttttctctctacaacagcagagctgagtacttgtgatagaaaccttctggtccacagaaacctaaaatatttattatctggccctttacagaagaaagtctgccaacccctgcttaaatagcagtgaaagatgcaggttgtgataataaaatttaataaccattatgtaaaataatacctgtctattctctatagtcacaggatctatatctagctcatccaagaaaaggtttggattattttttatttatttatttttttgagatggagtcttgctctgtcgcccaggctggagtgcagtggcacaatctcggctcactgcaagctctgcctcctgggttcaggccattctcctgcctcagccccccaagtagctgggactacaggcgcccaccaccacgcccagctaattttttgtatttttagtagagacggggtttcaccatgttagccaggatggtcttgatctcctgacctcgtgatccgcctgccttggcctcccaaagtgctgggattacaggcgtgagccaccgtgcccggccaaggtttggattattaaagtttaaaagcaggagaatcagaaaacacttctattttaccataatacatgttattcattgttctatcaagagaccattattatcaactctgattctctctctctcactcttttttttaagagatggggtctcattgtcttgtccagtgatcacagctcactgcatatcctcaaactcctgggctcaagggatcctcctgcttcagcctccagggtagctggcactacagacgtgtactaccacactctgctaattttttttatttttttgtagagacagggtctcactttgttgcccaggctcgtcttgaacccctgcacttaagtgatcctcctgcctcagcctcccaaagtgctaggattataggcgtgagccactatgtctggcccctctctctcttttttttttttttttaacctttcaatgttttgtgattaaccatctgtatagtaagtttttctttttaatttaaatttcgttttcaactctgattatcaaaggatttgagagtatagtctctctacaagtctcaagtgccaggggtctataatgaacttaccttggcactgaatcctaactttagagtgaaagactgctttactcctaaaaggtttttccaggtggtgataaaaaagcacaacaaagtctgcatagcatagttgatgaaccctacatataaatgctggcctaaaaacatactcaagcttgcagattaacaagcaagaaatattttgaatagactgtctaataaactaacaagtctattatttggaggggagtaaagagttatttttaaaaagtgttttaagaaacactttaaattcaaccaaacttgaccatgactgtaaaatcaataaaaataactaagttaagtaagaactggagtttcagtcttcagagagatcattaaagtagctctgaggaattctaatcttttcaggtagagattttcaatcagcagaacaatgtgaagggctgttactgggattcagtcagcgagcagtcctggaaaaataaagcttctaggagtgaagcctagactgcagcttcacagcctcactccaatgagttcttcagagttaacggtcagatcttttgtttcctggtatctcataatctttatcaaaccagctattaggtggctgtgacccatatctgttgtgatcattgcagttactgaaactgaactattaacacagtgtttttttttttcagttatgagatccaatagcttttccactgtaaagaatgtagcacagaactcttcaagaggagttttcagtactcttactcacctgctattcaatactcctaagatttcaaagatgatgagctcaaacatggtgcaagaaaatgcaaacgtcacggagaagatcacctgtacaacatactgacgtatctgttaaaagccaaacagagactagaagttatttccttgtttaaaaactgaactgataacctccttctggttacaagtcagaaaacttattttgaggaaattctcaagtcattggaagtagggccacaacagcaacttgcctggagctaaagaaaaagatcaatataggtggcacttctgaatcttgagtcactattaccagcatcctcctgtggatgaagaattttgaggacaagaagatgaagtgacagggtcataggtagcacttagaattcctgatgcatactgacaaaaaactgacagattcgtacataatggttaatgtttaaaggggttcttcaacactctgcagatcctggatcagttctggaaccttcctcgggaggtcttaaagtattgggcagaagaaaatctccagaatcccaggctctttcagacaataaactccctgggaaagtttaatggagaatatcctagaaatgacccaaatgtagactataaccactgatcttattactaattaggagaactaactaggaaatgtcgagtctagggtggtgatcttctgaatccaaagcttaagataaaaacaacaccagccttgtgttgcgggaagtcagggaccccgaatggagggactggctgaagccgcagcagaagaacataaattgtttcatggacatttattagttcccaaaattaatacttttataatttcttacacctgtctttactgcaatctctgaacataaattgtgaagatttcatggacatttattagttccccaaattaatactttttaaatttcttatgactgtcttactttaatctcttaatcccgtcatctttgtaaactgaggatgtatgtcacctcagtaccctgtgatgattgcgttaactgtacaaattgtttgaaaaacatgtgtgtttgaacaatatgaaattagtgcaccctgaaaaagaacagaataacagcaattttcagggaacacggaaagataaccataaggtctgactgcttgcggggttgggcagaatagagtcatactcttcttcttgcagaaagcgagtaggagaaatactgctgaattctttttccagcaaggaataaccctggggaaggaatgcattctgggagagaggtctatgaatggccgctctgggagtgtctgtcttatgcggttgagataggactaaaatacaccctggtctcctacagtgccctcagacttactaggattgggaaattccagcctggtaaattctagtcagactggttgtctgctcttgaaccctatttcctgttaaaatgtttataaagacaatgtgtgcacagtgggacacagaccctcatcagtaattctaatttttgcctctgctttgtgattttactgccctttgcagcatgtgatctctgtgacccactccctattcgtacactccctccccttttgaaatccctaataaaaacttgctggttttgtggctcggagtcaccatcacggtcctaccaatatgtgatggcactcctggaggcccagctgtaaaatttctctctttgtactctttctctttatttctcagaccggccgacacttaaggaaaacagaaagaacctatgttgaaatattggggactggttcccctgatagccttgggattttggtattaacttataatataaggtttgcaattcagggccagatagacaaatgaaagggaacatttgtgagacattatgaattaaattctctcctacagaataactatttgctattggtacatatcctgatatgactaagacataatccttgctcctaacttctgggctatatttgatttgccttttttccccccttttaaatcaattaagtctacttatattctgcaatctaatagttatatagtacttatttggtaaaagcttcctatcttggaaatgaacataatgtttctttaatggagacatttttcttgtcaatctaaatcatatagtgtaagtatgacaaaatgatttcttctcacctcatagtctttaaacaattggcgcatgaagaaaagccacccaaatccaaaaaatagtatctggaggagaaagaaaatagaatgtcaatacatattttcttttgagaaatgttttatagaaactcttttatgataaaaggtctgctaactagacggttaacttatttcagggattaaagataagatccactcttataagacctattattaaagctcatgacattggaaataaatttttaaatgcccttggagttttgaagttatccatgttacagagtatgctttaagacaaaaatggaagtacatattttgccataatcttatgataatcattatatgagccagagaagtttgcaaatagaaaaggagtcagtggccaggcacggtgcctcacacttgtaatcccagcactttgggaggacaaggtgggcagatcacctgaagccaggagttcaagaccagtctggccaacatggcaaagctccgtctctactgaaaatacaaaaattagctgggtgtgggcacctgtattcccagctactccaaaggctgaggcatgagaatcgcttgaatctgggaggcagaggttgcagagagccaatatcgtgccactgcattccagcctgggtgatagagtgagactaggtctcgaaaaaaaaagaaaaggtgtcagagtgagacttgcttcttatggatgatccctgattgcaagtatttaaaaataataccagcctggccaacatggtgaaaacccgtctctacaaaaaacacacacacataaaaattagctgggggtggtggggtgtgcctgtagtcccagccacctgggaggctgaggtgggaagatcacctgagcctaggaagttgaggctgcagtgagccatgattgcaccactgcgctccagcctgggcaacagagtgagaccctgtctcaaaaaataaataaaaataaattaatttaaaaaataaaaacttcaggggagaggagttgagaccaaaattagaggagtagtagaaagcctaatattttttatatctgtttccttcagagagttttcttagcttctccaccatcctgcctaatctacataaaagtggttttcatctcaatgtaaagccgagagattgcaggatccctctttcgtcagttttgtttcaaactggcagagaccgtagccacatgacagctgataaagctggtctgtagtaaacagaactttctatacatacacactgacacaactactcttttcttcttaaactggctaggacctttatgaataaaatgattttatgtctttctagggactactttactgagcaagtgtaaactcagtagtttagcacagactactttagcttcttatcatgcccctgctgcctagcaaactcatgtgttcagccccctggaacttctttggttctttagatccatattctttcacatcgagacctgtgtagatgtcctctgaaaggaacttctctctagccctctcccagttatgctatttactccccctggaaggccctctctgccctcccaaatgcagataaattgctttttatataatcctgttttacattgtacttccctcatcaaagtgcttaccatacagttttgtaatgtgtgatttaaatattttttgacattagattataagctctatgaggacaaaaaccatgtttgtcttgtaatctttgtatccttggcatccagcacaaagcctggtacgtagcaggctctccataagtgcttgctgaatggctaagtggtctacataaaagatggtttattcttcagcattcaatcttaaattttctgtaataactcctacgtgctatgctaagtgctgaggatacaaagatgaataggatggttactaccctctaggagctcacaatatagtgaagacagtacataaataattataacataatatggatgtgcaatgatagaaatacatacatgatattgtaaaacaatatgaaagagggagaccaaaccaatctgtaaggggttaggacagattttctggagaagataatgcccgagccgaaggaagttttaatttggggttaaaacctgatattgtatgcacattttggggttatgtgcatttttctagagtggtttcaaggtattcatcacacagtcaaaggtttccaccacccctaacataaaaaccatcctctcaaaggatgaataagaatcaagtagggaggctggacatggtggctcacgtctgtaatcccagcactttgggtagatcgcttgagcccaggagttcgagaccagcttgggcaacgtggtgaaaccccatctctacaaaaaatacaaaaattagctaggtatggtggtgcgtgcctgtagttccagcttatggggaggctgaagtggaagggccacttgagcctggcaggtagacgttatagtgagctgtgagcatgtcactgcattccagcctgggtgacagagcgaaaccctgtctcaaaacaaaacaaacaaacaaaaaacgaatcaggtagggtaaaaacaggtggtaggggtaggaggacagggctttccagatagcaaagggcatgagtaaaggcgcagagtgaatagcatggtatatgccgggaactacacatggtttggtgctgctagaagatgaaattcaaagaaggaagaggttaaaaatgaggctagacaggaggagtggatgtccaatcactgagagctttgaaggccaccctaaggagcttagattatagtctgtaggtgatgagggttatttaagcagggaaatggcatggtctgatttgttttatattatatagagcggtatggtggctgtatggaagacacacttgaaggaaacaacagtgtagaaagagaaacattatagaaatgtgttatgggaattcagatgaaagatgataaagccctgaattaagacatttggtgacagaagaggagaaaacagatttgagaactatttagaaggtaaaatcaacagggagaagtcaaggatgactagtttggaatacaggatgaagagtgaagctacccaatttatataaagaatactggagaaagaagaggtttaggaaagggggcagaggatggggaaaatgatgagctcatttttgaacacactaagggcctgagggacagccagcaagatggatcaagatatccagcaagtatctggaataaaagacagattgtgaaggcaggtctaagatatacctatgagttgaaaccaccaaagtacatgagatcacctgggaatagtatctagagtaaggagagcaatgtgccaagaagaaaacactagaggataaggaaaacaattttgaatagtgaggtagaggcaggaaccagagtgtagcaggtcagaatgaatgggagctaaagcagtggggacagtaaatgcaaattactctagggagagccaggaatgagaaaaaaagaaaacattagataataggctagagaagaatgtggaataaagggaaagtttattggccaaggggaaagaaagcagtcaagtaaggagaaaaagatgagaaggatggtggaatactagaggataaactgataatactattattaatatgattaggtaacttttattgagcatttactatactacaggctctctaagtagtacttagcattataatcttataaaaataattaaaaactcagtacagtggtttgattatcctattttcacggagaaagatgaggtttagagaagttaatcaatttatagtaagtgtcagaatcaagattgaactcaagcttgtttgactccaaaatctgtgcttttttttaaatattattttttcagctcttattgagtctgtctgtttagaaaatctgtgcttttaaccacttcaaaatacgctactctaagatcaaaggtaggtagaatggctttaaaccggagtaggggaaccccgttttctgaaatgggaggaaaggaggtaagaatggttgtgaacacagataaccttttagattaaaatgcagaaagtattcatagtaggagatcataccttttggcttcacttttgttgagtaagtacgaggcaaggttatctgctaagagtaagagaggtgagttagaaaaaggagctttgaggagagtgacaaagattcggagaaactttgaggggaatgaaacaagtagctgattaaggtcaagaaaaggaataattcagtgagctgagggttaaactcctggcgttggcaaactacacagctatgtgattttctatagtagccttcaggcctctgtattagtagtaaacaaactatagcagtgatccaagtgtggacttatatatacatgaaggtaaacgaacaagagggtgtaagaaagtaagttggatccaagcatctagatcaagcagaaaaggaaagggtcaaacagattaggagaaaatgtccaggatatcctttggctattataaatatttaccggtggagacagatgtaaattcagagtttagagaccatatttatatgacttatgaagccacgactgaagacagagaagttgggcagttaggactgagggtggtatgtatagtggaaatggatgattaaaaaaaaaaatcaccaagattgctatgaaatggaagagaaaacaagcaaaaattttaagtttatatggtggggaggggaatggaagaaaagagaaacagatatatacctttaatatttcattgtggcctcctttcacattgaaaaagaaaagcttaaaaagactttcagaacaaaattatgtcctttgcagcaacatagatgcagctagaggccatcatcctaagcaaattaatgcaagaacagaaaaccaaataccacatgttctcacttctaagtgggagctaaatattgggtactcaccaacataaagatggcaaaaacagaaactggagactacttgggggcaggggaggggagaagggggaagggttgaaaaactaattattgagtactatgctcagtacctgggtgaccggatcatttgtaccccaaacctgagctcccacaatatacccggcacaagtaccaaatctaaaataaaataaaagttgaaaaaaaaaaaaaagacttaaactacacacacacacacacacacaagtagctggagaattcatttacatccaagtaaacacaaattctggcaagattatagaggatccaaaaagaaagcagaagcaaaatgcaatttcaaatagctttgcaaataaaatggaaggcgtatagcttcttattaaaaatgagacttgatactttcagaattgtacagagtcttgaccttaggacttaagagtgtactctggaactgataagtcttatgacggtatagagggctcaaaacatgagttagttaacagttgcttttaaaaaagtgacttctgggttgaaaattagctactgttaaaaaaaaaagatggccatcagcaggacagttattaaagaattaactataaaagacacctttcttggatcatttattcacccttttaatcatttaacaaatatttattagtgcctaatatgtgccaggtccaagggatagaatggcaaatgagagcatgaatgctactctcaaggagtttataatctatggaggagataaacaagtaattaccaaacaatgtggtagtgttgttacaggggaagtaggtgaagggtactatggcagtaggtatagggacatctagtccagtctaggggaagcttcttggatgttcaacttgagatctgaaggcttaaagaaggggagggatatgaggaaaaggcccagaaagagaaaacacactgtgtggaaatctggaggcaccatagcatcgccaggttagggaactaaaagaagttcaggaagtctaaagaataaattggagccacagctgaagagagaagagccagggtcccatcaataagggacctgaaaagccatgtaaaggagtttgaacttcatcctgtgccgtggtgagcaagattgaatacgtgacctctgatttcagatttcatttcaaataaacctttcagttaatacaaaacagaaaaaatgagcagggaggggcgcagggggcaatggtggtgtttccaaggtaaccacacctctctagagaggtgctttttattaaacaaatattcactacaactctactatgtgcccgcaactgatctagatgctggtgaatacaggagagaacaagacagacagtatcttggacctcatggacagataacaaacacatgaatatacaaatgaaccatagtaataaatgccaagaagaaaataaaacatggaaatgaggaagaaggcagccgaaatggaaagctactttggttgtgggcagggtgtcaggtaagaccttcctaaagcgacatttttattaataccgaaaggatgataaagtagccacataaatatctgaacagagaacattccatgcaaaggaatctttgggtctttcttccacatttgtaaaaaccaggtttaacaattaattactgcatgtggatgcatgtgtgaagtgaaagtctatgattataaggcatacaaaattagaaagccacttcctcggttcaacgtatcaattatatccatgctaaaaatcgtagaggctgcaatgcaaagccaattttctactgacattcttatctttattctaaatgaaaagaaaagctaattaaatattgttatttttcttaaattggtactaaggctaaaaataaccctgagttgtcaccaagggcactgggtagtcttagaaaggttttaagcagaagagttacatgtctaggtttttttacattaatacatttgaatattatgcagccaataaaaacaatacttatgaaaactatagaaaaggtggtaaattttaaaaatgaaaaaactattgcattagagtggtaggattatggatggcttttccttctttcttattttcttaaatattgtaaacaagtttttgaagagaaaaggacaatgctccgctctacggagacgagtattaggatgaagcaatacaaaaacggaatcaaagaacacaaatttagttcactttaagcccccaaaggtaactgcttctgttatttgccgtttgagagaaagaacaagtaaaaacaaccacacacacacaaaatctttattggaaagatggggggaagaaggtcaacaggcagtctgagcttcacaaatattggccaacaattatttattgaatgcctgcacttggaagtggggatacagctatgaacaaggcaggatctcaaaaaacaaaatcagaaacacagacataaatgatgccagtgctatgatgaatgctaggaagaaacaataattaacaatagattacatggtaaaagcaagaggctaactagacgaaacttctattgagcagagacagtgtcttacatgtttttacgctcagagctttatataatggtcgataaatgtttgttgactgtacaaacaaatgaaggtggccaatggagaagaaatgagggtcagaaaaacatccggaaaaggtgggtaactaagcagaggataaaggacgaggtgtcagtgcaaaaacgaaaccttatactttcaagcacaggtattaccttatactgatactttgaagcagcaaatttctccacacccggattcaggatttgacatctaacagcaaagcctgcactgacgtgtcctcagtatccagtattggcgcgtcgcacaccgcgcgcccagaaccacacaggcttccccagtccaggatcagttggcgcagcccggaagcttcgaggagctcctagaaccgccgccttagctggcggcgccggctcttagcctggaggtcggcggaccgcttccaaaagtggaccgaaattccggggatggatgccgggtggggacgcggacggccgcaggccagtctcctgacagccggggctgagggaaccggccgcagcaaatcgcacaccctctctgggtgccagagtgactggcgcaggacgcgtaagagaggagcgagaccccggaccagcccgcaccgcggaggaccggagagggcgattcggtaaagggaggcggacgggtgtcggggcgggaggcggtgactcacctgggaggtaatcatgatgctggagtcgatgaggaaactcatggcgaagtgtaaggaaggctcctgcctccacttcccactccccgaggccacagcacgctggggccacaggccccctcacacggtctgccttctcccaggtgctgcagccgggactgcggctctccagcccgacgccatcaagctgcgccccagtcagccaatcagcgtctacatccacagccccgcctcgggctcggggtgggtggggcggacgctaggctcccgccgcggaggccccaggggcggggcttattaggggcggtgctaaaagcagcaatgcaaggtagcgttaacgtttctgaggctgaaggaggtagggcctgagagctaagtggtaattctgttttgtaatgatcctaagataataatggtaattatagtaagtcgggcattgtgtcctaaatgttataacttttacttgactcggcaaatatgactgtacaaagtgagggaagactggaaagtcagatgagatatgaacaaatataactaaccaaatacatttctgtgacaacaatgaaaagcacactgtctgtagcaatttagtgataatattgtactgcatatcagtcaggccacaggtggagtactgcactccatgtaccacactttgaagagattttacaggccgggccggctcacgcctgtaatcccagcacctggggagaccaaggcgggcggatcacctgaggtcgcaagttcaaaaccagcctgacaagcatggagaaaccctgtctctactaaaaatacaaaattagccgggcgtggtggtgcatgcctgtaatcccaactactagggaggctgaggcaggagaatcgcttgaacccgggaggggaggttgcggtgagccgagatcgcgccattgcactccagcctgggcaacaagagcgaaactccatctcaaaagaaaaaaaaaagaaaagaaaaaagaagagagagattctacagagacatattggagctcgctcaaatgtgagccaccagataagggctgctggaaggaggcgaagaaagatgactcagaacatgacatctgtcttcatgtgaaagaatgggtagaactgatgtggcgctacgaattatctgtagggcaaaggactggaagttaaatgaagatagattttaattcaaaacaaggatcagttctttaagagtctgaagaagggttattttaggaagtagctgcctctgcccccttcccacctattgcagtggatcaaatatacactgaatcactacctcattcattcaacactcatttcatgaaggcttaacgcattgctgtggggcttactctgccaccgacctggggcctagctaggctttgtagtctatatagtctcatagtcctgcaaactggctccagcccaggaaatcaccctgtgtaggagtggctgcagtcaagacgcaggaagacaatcctgaggggacctgacatccagcatctgagttcagactactatagtttgaataagtgatctgcagattcattatacacaagggaacatgtcttccttttgttggattgaactctgtgataccaagcagtcaaaactacctgtcagatgtccaatccctgatccagaatttcaaggagctgtggaggcagctgtacaatgggagtgtcataaaccagagaactttgtgtccaggctatatctattaggtaagcaggtagattcccacataacagcacctaactgacattcaagagtgtgtagagtgcagagtgctgaaagagactatcaaggcaagcagtttaccttggtggcttactggggtgcacagtggggatcagaatatcagtaacgaggaatagcagagaaaggtgtgcaatacctgctggcctaaggcctatgcaaagctttgggtgacactattcagaatgctccctactgtaccacttgtgtccaggtaaaggacaggcctaggtgattcaagcgactgctttatcccctgattttgattgaggaatgtctttagaaaccttcgcactgcatttagtatccaattgactctcctttcaaagcaagtctgtactgctggtggtggactctgacactaaaatggcttgtcctcccatctctactgctggtaatattctcccgatccactctagctgctgccatcctcttagaatagtgggatcttttggttctgcctccatggacagtcacaccatctgggctctgagtccccagtttgtgctttttccaagggagcttttcaaaatatgtcatgttcataactagtagccattgtttgccactcatccagagattgacagccagtcccatagatgtgctacaaagagtcaactgacaagatgatcagtctgtgtcctttggatgagtgtttgctcacaccactttactgtcctttttcatagcaactgcagtgttcatacctacggtactctcacacttcccagcaccatccacatactgacagctaactacttcatccccttcctccaaattaatgcaaaggactgggcccaggagttgacactaacattagatccctgggaaacaccctagtacttcttctccgtgcacttacatagcacctgcccatgccagtggctggatgatctctgttagggattttcttttgaaactttttacttattatgacatagttgtagattcacatgcagttgtaagtctgggatcgtttgagacatatggtatcaccaattccgtggcatcctactcccgctgtctcccttcatggatagacaacctatcttgtagttttgcccactgtgccaggttcactgagtctctgaactcccctgtgtgccccactaagtcaccagtgtaagctggacaggaaaccccaagtattcagaggaaaagtgtttatttcccaatggtcccatggacagtatctatacttgatacctagaaaatatataagtgcagttttctcaaagtgtggttctctcatgacttggggagcttatttaaaatgtagattcataagtcctaatgtagaccagtggacttgggatttctgaaagtgactcccaggaggaatctaggagtcaattaattaataaataaaaattatatatatttatcatgcataaaatgatatcttgaaatatgtatacattgtggaatggctaaagcaaggtaattagcatatatattacttcagatatttatttttgtggtgagaatacttaaaatctactctcagagattttcaaaaatgcaatacatttttattagttacagtcaccatattgtacaatagatctcttgaacttattcctcttatctaactgaaattttgtatcctttgaccaacatctctccaaccccacccgactatcccccaccagcccctggtaatcaccactctactctctgcttttgtgagttcaatttttttttaagaaggaatctgcatttgtaacggcatcccaggagattcttatgcatactgactggggactggttgtgagactctgctccccatctcaaaactttcctagagtgagttagcaccttcacactaggaaaatgccagctccgatttgtctagagaaaggggactgagggccagagtggtgctagctttgctctttgcttttttccactcccgcaccctttctctagatatgctcactctatagcctcaggaagcctaaagatcttttccaaccacttgcgctttggctcaagaattccccttcatcttccttgagtctactttgaacctcttccctagttggttctcacttttccagaccttcttggaggtgcattccagtcctttcctcttatacaatctcattttggatatattgaccttggtgctgacttggtatgcaccgccttgtccagggccttgactggttcatatgagttagagtcagctctgtatcaagtgcttggttgttcttgaggtcgtgttcctgaggaaagaagattaaatagttgtgtggttttatgcaagttactaaactctctgtacttcagtttcctcatctaaaaaatagagatagtaatagtatcttatctcataaggttattatgaagattaagtaatatacataaagccctcaggaaaataagcactttatagtaagtatgcaacaatttttacccattattattattattatgagtttacattcagttttccttcatcattagtttcaatgtatatttatttattaatatttataaatgtatatttaaaagttttggttgtcagttattcaaattatactgaaaagactgatgatcgtagagctctcaaatttggaaagattcagtggcattatttgaaatatataacaccaactttttccatttattaaaactaattttgggattctctgttgatataattatcatgcagaatgaatttgatccatatattttgtgaacaaaggggaagaatatgtagagattaaatttaaaatggaatatattagttgaagttcaaagtaaaggatgttcatattcttattgtatgaactgttccaaacttctggtcccctgccgtctgtgctcaggcagagcagaaagctctccctactgccccaccacttcttgctccaggactgacctcttcttgggataactaccagcagggacatttgcttattttaaagaagtccccatctttaccactggattgagatttgccaccgtaatgttaagacagttgcaaaggagtacaacactggcatatttccaaagtctgggatattcattcttattcttggttaacgtgatgcatacccacacgaacgcacatataccttttgattttcccaaaattggatcacaattttggattcccaaaattggaggagtgctatggactcctagtgatccaatattgaaaaaatggatcctgtttgtgtacccgcaaaatgcatatgttgaagccctggttcccgatgtgatagtatttggaggagggcctttgggagctgattagatttagacgaggtcatgagagtgaagccccatgatgggatttgtgcccttccaaggagatgaaggaaccagcacgctctctttctgacaggtgagtatatggtgagaaggcagctgtctgtgaaccagaaggagggccctcaccaagaagtgaccatgctggcaccctgatcttggacttctggcatctggaactgtgagaaataaatggctgttaaatatatacacctactatgcacccacaaaacttaagaataaaaaattttaaaaactttgttgtttaagccacctaatgttcggtatcttgttataatagcatgaactaagacaatgagtatactatgttgttatatatttttcattatatttcattttagaaatattttatggggctgggcatggtggctcacgcctatagtcccggcactttgggaggccaagatgggcggatcacttcaggtcaggagtttgagaccagcctggccaacatggtgaaaccccgtctctactaaaaatacaaaaattagctgggcatggtggcacatgcctgtaatcccacctactcaggaagctgaggcaggagaatcacttgaacctgggaggcggaggttgcagtgagctgagattgtgccaccacactccagcctgggtgacagagtgagacttcatctcaaaaaaaaaaaaaaaaaaaaagaaatatattatagtattataggccaggcatggtggctaaaacttgtaatcccagcactttgggagtccgaggtgagaggatcacttgagcccaggagtttgagaccaacctgggttacattgggagatcctgtctctaccaaaaaaaaaaaaaaaattagccaggcatggtggtgcgcacctgtaatcccagctactctggaggctgaagtgtggggattgcttgagcctaggaggttgaggctgtaagaatctgtgattgtaccaccgcattccagcctgggcaacagagtgagaccctgtctcaaaaaaatgtatattatgaatattttcttgtgccaaatactttataacatttttattgactcaataacattccatcatatggttatgtcatttgtaacttaa

SEQ ID NO: 356 - DNA, 479155 bp, Homo sapiens
caggacttcagaagatgttctatttgaaaattgagcgctgtgttctttttcgtttgaaaaattcccacttcccatctatgtgctttatgattggaaaaatacaaattctgattgaaaatagggtcacaaaattctggctctgattgaactacacaatgtcttccaaaagagaactttttatttttacccttacaacattctgcccttttgttttccaagtatggaggaatgtgacgccctctgtaccagtctagccatcatggtgcaagggaagttcacttgcttgggcagccctcagcatctcaagagcaagtttggcaacatttacatcctgaaggtcaaggtcaagactgaagataaattagaggattttaaatgttatgttgcaacaacatttccaggtaaattaagttgtgctacctttgtcagaaatgtattaaattggccgggcgcactggttcacgcctgtaatcccagcacttttgggaggctgaggtgggcaggtcatttgagctcaggagtttgagaaatgtgttaaatcatatttgttgttctcaccatccatatgatttatgtcttcaataccagttttctgtgagttattgataggtattgattttctataatgttcctttggcaatgtttgatattatagtctcttatgccagattatgctaagtttcacaaaaagcagaagtcctcacaaactcttacatcacctaacaaggcacttttatgtttgtgctgtccatataaattagttgggcgcagtagctcatgcctgtaattccagcaacttggaaggctgaggccagagaattgcttgagccccagggtttaaggctgcaatgagctatgattgtgccattgcactccagcctggcaagaccccatctctaaaaaaattaatgataataaataaaaactaaaaataaattatatatctaaagtcctattttagcataattctcaattatttttacagattattcatgccaaattttaaggttttttccttcacactgctcatgcaactttatgcttttgctgtctcagctaggatatggtattgaaatgcaaataagaactggtatttctctcctttcaagagtagtttggtttctgagtgccgtttcttcatgctaaattcagtaagcacctctccgcctacatggaacagtacaagagagagcatgcatttcgatctcttatctctctttccttaacctaaagcatgggcaatggcaaggcttttaataattctggtttttcatcttagtttccactttgttaggctgagcaaaataccgcagaagttcccgttgtgtgttaggctaaggggttgaaaatttgtctcctaggcaatggaaaatagcaaaattgattacacagtaagaatgaaaatcagggccgggcacagtggctcatgcttgtaatcccagcactttgggaggctgaggtgggcggatcacctgaggtcaggagtttgagaccagcctggccaacatgatgaatccccatatccattaaaaatacaaaaattagctgtacatggtagcacacacctgtggtctcagttactcaggaggctgaggcaggagaattgcttgaaccggggaggcggaggttccagtgaacagaggtcatgccattgcactttagcctgggtgacagagagagactctgtctcaaaaaagcaaaaagagaagaaaatcagaaaatagatacgaaatggatggtcaagcatatgtggagaacgagctgtgtagaaaaattatcacctcggtgttggtcatagtgtttatggtgtgcccttgacacatgtagatggatatgtccattaagaagttgaatattcatttatgcattcatgtggcaaatatttttgaggacttattgtgtcaagagttctatttgatgtgatcaataaatcactttaggaaagctctataggctgggcacagtggctcacgtctgtaatcccagcactttgggaggccaaggcaggtggatcacgaggtcgggagtttgagaccagcctggccaatattgtgaaaccccatctctaccaaaaatacaaaaattagccgggcatggtggtgggtgcctgtaatcccagctacttgggagactgaggcaggagaatcgcttgaacccagaaggtggatgttgcggtgagccgagatcgtgccactggactccagcctgggcaacagagtgagactccatcttaaaaacaaaaacgaaaacaaaaagctctgcacacttcaagataacacagaaaaacaattcaacaaaatcgggtaaacaataaatgacccagactagtaacttaatagagaaattgaaattactttttaaaaaatcaaacagaaatcatggatatgtaatatacagtgaataaaatgaataatgcagtagaaagcattaacagcagagtttatcaagcagagaaaaatatctcaactcaaaataggttttttgaaaatatacagttagatgattaaaagaaaaattaagaggaatgaagaaagctcatgggatttatagaacagcatcaaaagagccagtgtttacattattagagtttgtgaggaagaagaaaaaacaaattgttggaaagcttaaagaaataaaagcagaagattttccaaatactaagaaaaacataaatatccaggtacaagagggtcacatatctgcattcggattcaatacaaacaaggctacatcaagacattataattaaatggtcaaaaatcaagcacaaagagaggatctgaaagcagcaagagaaaaaaaaagcaaataacatataagggagattccataaggctagctataggtgtctcaaccaggacctcataggcaaggagagagtaggatgacatgttcaaagtactgaagagaaaaaaaccctgccaaccaagatactgtatccaatactatgttgaataggagtggtaagagaggacattcttgtgccagttgttcttgtgccagttttcaaggggaatgcttccagcttttgcccattcagtatgatattggcggtgggtttgtcatatgtcatgtcatggctcttattagtttgaggtatgtcctttgaatatctagtgtattgagaacttttaacatgaagggatgttgaattttatcgaaggccttttctgcatctattgagctaatcatgtggtttttgtcttcagttctgtttacgtggtgaatcacatttattaatttgcatatgttgaaccaaccttgcatcctagggatgaagccaacttgatcatggtggacaagctttttgatgtgtgggtggattcagtttgccagtattttattgagaatttttgcattgatgttcatcaaggatattggcctgaagttttctttttttgttgtatctctgccaggttttggtatcaggatgatgctggcctcatagaatgagttagggaggagtccctcctttggtcaccagcctacatgtacctgtaggaggtagctagagacccctattgggaggtctcactcagtcaggaggaaagggatcagggacccacccaaagcagcagtctggctgcttattggtagagcaggtgtgctgtgttgtgtgggacctttccttgttcggactgcctgtattcttcaaagctgacagactgaagcagctgagttgaccaaaccacagagatggcagctgcgcctcctccaggaacttggacccatctcagggagactctaactcactgccatttgttggctgggattccaaaccagtaggtcttaactcgtgatgtgacgtggaagtggggcctgcagaatgacactgcttggctccctggattcagcttccttcctagggatatgtacagatggacctctcaccttgccagggatcccaaggctagagtatataaaactcctgggtctctgtgtgtgcctgagtggatgctctgtcaagacttcacacagctctgtgtatcagacccaaggccctggtggtgtgggctcatggggggatctcttgatctgtggattgcaaagatccatgggaaaagcgtggtttcctgggcaaggtctcaccatcactcactgcttctcttgtctaggggtggtggttcctttggctccgtgtagctccttggtgggccatctccactccctgctcttctttgttctccatgggtcgagtttttagcctagttggtcccaatgcgagaacctggatatgtcagtcaaaggtactaaattcactcacccctctccgttcctctccatgagtgctgtgaaccgcagctacttctaataggccatcatggatcaggtccctctgcaaacattagacttttagaaggctcagttttcttacattgggcatgtcagctgataatttattgtacctcaaatcctgccctcaataattgctatgaactccacataataagatgatttcatgaggaataaatctgaaagcatgaaccgtgtcatggataccaaaaagagtgggttagcgggttatatctcctttcgtattgacctcctctattcacccctccacagtatataattaagtaaattccattattactccatatccatcaagagaatgggaacagagaatggcttcctctcactttctcaattctctgttcttccaccttctcacctctcccttctgtgccttttgtcctccaacatacacttgataggaattgggggagtggaggagaggcttatctgagttgggggctgaaggggagattgcaatggtaactgtgtttttgttgctgttgttaaaggtgtttggcattttggaggaagctaaagagcaattcgatttagaagactattctgtcagtcagatcacactggaacaggtcttcctgacctttgctaacccagagaaagcatccagtgatgatgaaaacgaggtgccatgagattcagttacaaccagtgacccttgtgtctctcatagatgacacctggatgcatgggggaccttcctgtgcatgtatatcttggtgtacatatatttatgtaataaagcttttcccaaagaagaaagtttgtccccttcattgcagatttagatgagcggcctgtgtatccagcatgctcaaatccaaagacatttggtgaaattcccattttctctccttgagatatgaaagagcagcatttatcagggttgggacaggaacctgttcctgagtgttctggacatttgaacagaaagatccagtaatgatggagctgtcagatgggacagcccaaagaacaagagctttatgtttcagcagttgagttatggataagaagcgcataaggcctggatcacatcagctttcctatggatacacacacacacacattcacactcacacacgcgtgcagatatacatgcatatacacatatatctaatataaattcatcaatgttggagggctgagttgggttactatttcagacatccaaaataaagttcatatgcttcagttgaaagagaatttttgcaccaagaacatttgggatccatgaccagaaaaaaaaggattatttaaaaatagtgtgttttcttttctacaattatctcacctctaataaagaagaaggagaaataaagtggagagagagggacacagagatattttcttctgattcttgcctaggtagatagatggagtcccccataaataatatgagaaatctaatcaccttttcaggattcatagacaactaggatggttcttgcagaattgcaagatgaagagagtctataaaggtgctctattttggggtggcttgttcaatgttttcaaatccttaattggatattgtttattataaagtgacacccaccagatgcttactgttcttttttttgttgttgttagataaagagggaatttgagtttgtttctatgaagtgtctaggagcatacgaagtctccaattaaaacaaaattgagccgggcgcggtggctcatgcttgtaatcccagcactttgggaggttgaggcgggtggatcacctgagttcgggagttcgagaccagcctgaccaacatggagaaaccccgtctctgctaaaaatacagaattagccaggcgtagtggcacatgcctgtaatcccagctactagggaggctgaggcaggagaattgcttgaacctgggaggcagaggttgtggtgagctgagatcgtgccattgcactccagcctgggcaacaagagtgaaactctgtctcaaaaataataataataataataatagaatatagctctttctctggttcataggctatgctcacctgagtgtaaatcaacagaggtgtttgactaattgctaaaacaatactcattgcagtctccaggttggcagggtggggaaaggctttggttctggttcagcctttatatggacaagatgttgtacaggtttaacagtgcaaatacctccatggcggccattccccctggagttcttgattaatgagaagaccatgtcataatctagtactcctccaaaatgagtaggctgtggaatttcatttctaacttctttatccccaagatcattaaaactgaattatggagcctactattccaatgtcctacaatagatctgacagctataattttgtagccctttagaaaaaaaatatcttggtaggactcttaaaagtatggcctggaagactgcaggtttgccatcttatccatggttgtctagtgggatagatgacttgggtctttacttaatgcaattcttgtaattaggttaaggtcaagaattggttattgtcctgaatttgatgtcttgctagaatatatgactgctcaggaaataatgatcatgtatgccagattatggggagtccctaagccccagattcaactgtatgtgaagaaatggttgaattcacttgaactggagcctcatgctgatgagcttatcaacacctacaggtgagtcattatgctgctgcactttttgttgatgctgctaatgttgaggtgctttcttttgtccctgctgtttgaaatgaagcccatagctccacctatgctccttttcccacaattacctaattacgaaactgtctaatgttctactaggtttcagatacgagtagtaaggcagatcaatgtagcttcacgtcgtccttttgcagaaatggaacaataaatcttaggtttttttgaactgtagcttctgaacctcaaaagggatcaattaagagggagtttaggattgctaaagcagctagaatttgaagagcagggtgatgataaagacgaagcgggggcccagaaatttgaatggggtttgctgtgagtcatgagctggcctgtgccatgtgcaaagggagagatgctgtgaggcctatcagagaatggcacctgctagactgagaactgaatgtgttaccggtggacgatatctgagttactggcggtgaatctgtgtacatctgcagctacctcaattcttgcctcctcagaagaaagaaatcaacagaggggcataaggcagaaaaagagaccaaggcaagtttcagagcaggagtggaagtttatttaaaaggctttagaacaggataaaaaaggaaaggaaagtatgcttggaagagacccaaccaggcactgaggtcaagcgctctgtttaacagtaatctttataggctggcccctttctcatgattcttcccttagggtgggctgcccgcatgcctggtacccccctcacccgttggaggtgagcatgcgcagcgtgtttaagaagttgtacccatgcccatctgagactttcttccctattctggtggagtaaccctggaaagtcatactccgccattttgtctcttaatgcacatgcccaggaagttgcttctccctggtgtctgcattcaattaacactgttaatttagtgcaacgggtgtggactatcaggaaatggcctctccaatttatctttttttttttttttttgaggcagaatttcgctcttgttgcccaggctggagtgcagtggcgcgatctcggctcacccaaacctccgcctcctgggttcaagtgattctcctgccttagcctcccgagtagctgggattacaggcacccgccaccatccctggctaattttgtatctttagtagagatggggtttctccatgttgttcaggctggtctcaaactcccgacctcaggtgatccgcccgccttggcctcccaaagtgttgggattgcaggtctgagccaccgcgcctggcccaatttatcacttagagaggcaatgtgataactgccaaatcatcacccgacattcctggtggatggggggagagccctctcctgtcccgctcatacctgtctaactacctgtaacaaaggtagacccagagtttacatagtgcagaaaatgtcggaattcttactgagagccacagtagagataccttactgagcaccccttacagttataactccagaaaagccatgccttagaagtaaagatcatgtcctagaataagatcaaaaacctaaatagacccaccctaataaagaataaaataaaagcctgacagaatcaaagggagcacgcaaaatatacgaaagctgggaaaagacgtttacttctgtgaaccaaaagtatctgagacaggtctcaatcaatgtggaaagtttccattgccaaggttaaggataagcgcctgagaggtatgtctatgcctttctccaaagatgatttcaagggcttcaatatttaaggagaaaggattgatatgggtgaaaaggaagaaaatttgaaatcttaattccagctctttgggaggccagtccagtggactgcctgaggtcaggagtttgagaccagcctgagcaacatggcaaaaccccatctctatcaaaaatacaaaaattagccagatgtggtggcatatgcctgtggtcccagctactcaggagactgaagtgggaggactacttgagcccaggaagtactggaagcactcaagcgtgagtgacagatcaagaccgtctcaaaaaaaaaaaaaaaaaaagaaaaaatttaaaaatgtgtgggtatacaagagacaaagggttgcatccccttgagtctttgatcagcctttcactgaatatacaatttacatgtgagaggatgggcagaggaatactcacttatgtcattgtctggctcagagaatcttcattttttttacataatacaatgtaaacaatagggcagaggaagccatcagatacacatttgtttaagatggactttgagttctgtcctttgtcctgcacctgtgaaaataagctatcaggcctggtgcggtggctcacacctgtaatcccagcactttgggaggccgaggtgggtgcatcacctgaggtcaggagttcgagaccagcctggccaacatagtgaaaccctgtctctactaaaaatgcaaaattagccaggcatcatggcacatgcctgtaatctcagctactcaggaggctgaggtgggaaaatctgcttgaaaccaggaggtggaggttgtagtgagctcagatcatgccattccactccagcctgggcaacaagagtgaaactctccaaaaaaaaaaaaaaaaaaaaaaaaaagagggaggagggagggaggaagggagggagagagagaaacagagaaagagagacagagagagagagagaaaggaaaggaagaaaaggaaaggaaggaaggaagacagctatcaatttacattgccagggtgaaattcaacaaaactgttttagggtaaagatcctcagatccacatggaattgccctgtgggcaaattgtaaggtaagttatgtagctttttatccttatagctatcttatttaggaataaaacgggaggcaggtttgtctgacatcattcccagcttgaattttccctttggcttagtgatttggaggccctgagattttttttcctttcacacttcctaactcattttatctatgacagaaaaatgcatgaatggggggaatgaaagtgaaagttaaagccagtatcactctggaacataaatgcacaaatcctaaacaaataagtagcaaattaggtctagcaatatattaaaagaataaaacatccagaccaagttgggtttataacaggaatgaaaggtttatttataatttgaatcaatcaatataacttaacacagaataagaccaatctgttcacctcaatacatggaaaaagtatatgtgaccaaaaacaataattatagaatattagaaattgatatgaacttttttttcccccccgagacagagtctcgctgtgtcgcctaggctggagtacaatggcagtgatctcggctcactgcaacttccgcctcccaggttcaagcaattctccctgcctcagcctcccgagtatctaagatttcagtcaactgccaccatgcccggctaatttttgtatttttttttcagtagagacagggttttgccacgttggccaggctggtcttgaactcctgacctcaggtgatccacccaccttggcctcccatagtgctgggattacaggcatgagccactgtgcctggcccagggaatatttcatcagagataatacctgacagggtaggattctgaaaggaatggggaaggaaatgccaacatcgaaattatgcattggggaagccatgattaatgcctctggccctaagatggcaaggtaatgttgttcccaagtataaacccacatcaccttcctctggtgtgttttactcctactgttgcctgctttctctttacattctcccaccccatactcaccgcgagcgctcaggctaggtagttaggctccatagagtcaaattggaccccacattaacgaaactaacaattcgagctttccagcaatgaactcatctgctcttccatgtctactcttttcctgtctgctggtttcctctcccagggctttcagtgtgttctacgcagaaaccagttcaaggactgggttttcttctgcaataaaatgctggagttgtggcagagacctccacagtgagaacagccacggagttggctaggaggtgacatgatgtggaagtggtggatgtgtccacaagatggcactcctaatttgtagcttaatgcttaataggacattttgcaattgacaaacttgggattttatgatttatgtagctgatatcatgaattatgtttcaaatcctgccacattttgaacagaatttatttttgcccctttctgatattgggtcataacctaagaatgagaggacattataagcaggtgtgggtgtgtgtgtgtgtgtgtgtgtgtgtgcacttgagtgtggagacttttgtgttcctcctacctgacctgaactgttgaatgatgaagttacaatgattggactcaggggtgcagctagctaacttgggaattggggttttgaagtactggagacagctttgtatgccatgttaatgaatttgaattttatcctgaaaaacgtggctgtcgttgaagaattttaagcaggcaggtggcttgatcagagcactgcttcccagatttcactcaatggtacctgtataacacattcatgatttttgctgtatctccgtatcatcaagttacttaacgtttttacaccaacttttattattttataaatgtacttaaagaggaaattcactactagcattgcttgccataatcaaaataaatatattattaaaatggaacagtgctaaataaggtgtacacatggacatagagtgtggaatgacagacaatggagactccgaaaggtggaggggtgggagagaggtgaacgatgagaaagtacttaatgggtaccatgtacattattcgggtgatgggtacactaaaggcccagacttcaccattactgcaatatatccatataacataactgtacttgcgccccttaaatttatacaaatttttaaaaggaaaaaatggaagtgttcatctatgtaccaacttaaaatcatctcacgcaccactagtgttaaatctaccacatgtggggaaactgtgtggtatgaattgggttgagggcgtccccagcaggcacagaaattgggttggtgccaggttcttaatgcccagatcttaattagagagcccaagtccgttgtaggcctggagcaattcagacacaaggcaaaaagaaagtacatttgcctatgccttgtaacgtctacaccaccagcctttctgaaactattgtgcatacgaagtcatcccaggatcttgtaaaaacaccgattcggatccaatatgggacctggagttcatacatttctaatcaactcctaaatgatattgatgctgatactgtcggtttcccaaccaagcaacgtagcaaggtacgaaactctaaagtccctaaagggcagggaccacgcctctcgcgttggcatagtgcctagctcaaggcactttctgggttaacactcgctgaggaccggagtgaacgcccccgccccaagtcgtcacgtgactgactttctccaactgccggtttcggctcacataacacacctactatccaaaacatttctattttcctaacacaaaaactatagctaagtttttatattctatgtagccccagcctaggacgtaaattccacgagaccaaaagccttgtgatgattccccgaggttgctgaccctcccggtgtgtcccgggcctgctctgggggacacagcggcgaatacgttgaacgaggcccctgtttcacggagctaaagatccagtaaggacttcacccagcgagaggcaactacgccgggcttcgatacccaatacctctgcagaaaggtggagtggcaggaatctcctgaagcctccaacgtccaggaacgcggaaacccagggcctccagtgcaggtgtcatcccggagggcgcatgcggagtcccaagagaggcgcgtcccattggacaatgctgagcggaagagcccaagatagcggggggagttgtgacaggctgctgcagacgtacttagaaaaggggtgcatactggatattcaggctaggagaagaacgcaaaaagcagtgacgtacattattctctgcatatatttacttgggaaattgtgcgtctccctattctgagtcttggaggaattggactggtccaaccttataaagagagcagtagagcgcggcagtatagagagtacctcacgaaggggacgtgggaaagtgttagcggggaacgctgggaaactcccggcctccgccaccatcttgctttcctttaatccggcagtgaccgtgtgtcagaacaatcttgaatcatgaagctactaaccagagccggctctttctcggtgagctcaggtggcgggtttgggaaagggctggggagcagtgtgtcgacaaggtgatacgaggcggaggtgtctggtctggggtctgggccttgggattcggtctgcccttcagctgaaccctgcgggccaagtgggctgcagactgggtcaggctttggaggcccagctcatgctgtgagcacaagagacctaacaccgggaaacctgaagagaggggcaggacgtgagagcggagttgaagcgagtccttggagagacttctgaaggtcactccggtactcaagtgctggagaaagagaccgtgaaacccagggggagcgggaggacggcgcacttagccccccaccttcactttatccgctgcagcctctgctccttggtttatcacggagcgtcagtttccccagcgaataaaagtataagaaaggagctaatgcagatagaacacttattacagtacctggaacttcattgttaaatactatggtgtcttagtagtctaacgttgcttttcttgatcgtatgttagacggttcctccaagacgtctctgtttgtcctcaaaagctccttaattaagtttccccttcaagcctaaattaaacatagctgtcacttggggaaaactcacacatcagggttatatcactgtgggacagtggttattaagaggggtaagggggaacacttaaaaaatcatagcgagggacagaatgcccccagggaaccggtggcgatgtttggagacatatttagttgcaacaacttgtaaggagggtgctattggcatggagaggccagggatgctgctaaacttcgccttacagcaaagaattatctagccccaagtgccagtagtagtacctgtgttgagaaacccccctagatggagatgcagaagaccagacctgggcatggaatgttcttatgctttatgtttacataaatgtgctgtgggctatatcgatttaggctgtaattgcattaaccttccaggtatacctagacacaccagtgattacccttggagggaagcacggttagattggcaaaagaccccaacatttccttctccattctattttgcaacagaaaaagctcagagaaaacagttggagaggcccaaagtaaacaaattgcagtaaacttgaaagcaattatttatgtgtctaattttagcactttatataggagaataaacttagatatatcttgttattagaacaaaataatttagaagattgcatgacagttactaggataatttgctgatttgaatgggacgattaagaagcacattaccggcggagcgcgatggctcacacctgtaatcctagcactttgggagtcagaggcaggcggatcacttgagatgaggagttcgaaaccagtctggccatcatggtgaaaccccgtctctactaaaaatacaaaaaaaaaaaaaatagccgggcgtggtggtggtgggcgcctctaatcccagctactcaggaggctgaggcaggagaatctcttgaacccaggaggcggaggttgcagtgagccgagatcgcaccgctgcactccagcctagacgacagagcgagactccgtctcaaaaaaaaaaaaaaaaaaaaattaccaacaaagagttactatttgggcacatttggttggaaaacacctaaaatctcacttggtaacggaattatagattattcatatttgaattgctatgcccatatatcttaaaagtttactttttggaaaattataggccaaaattacaaagaaggttaactataccatacccagcaaactaaattgatgacgataaagtaaagctaattgtaattcataactgaaaagcagtactaaaagcaagtgataaccagcagccaacctagtacagcactaatgatgtacaacaaacagccttctggacagcacagagtggaggcattgcagactgtgcagggatgtccgggaaactccagtgaggaggtgttcattgggtcttgggagcaccaaattttattcactcatcatctcctctaataacctcatgaactttagtcataatcagaatgatttgtatggcattgtataacatttgccaaaacaaactgaataaaatgaatgcattttgggtccattatctaatatttaatgggaccctttcaccctaccagtaactgcattttatatattgagaatctgatgtggatgaagccattattaatctcaggatgacatacatgtcataaatgttttatttagtcaaaaaaactaagacctttggttgtgtggtcttaatacagcacacaagagtgaagatacaatggaaaatattgagggcttggaggaagttggtatatactttgtctttttcttttttttttcttgagacggagttttgctcttgttgcccaggctagactgcaatggcacaatctcggctcactgcaacctccgcctcccggattcaagtgattctcctgcctcagcctccccagtagctgggattacaggcatgcatcaccacgccccgcttattttgtgtttttattagagatggggtttctccatgtttgtcaggctagtctcgagctcctgacctcaggtgatccgcccaccttggcctcccaaagtgctgggattacaggcgtgagccaccgcacccggctagtttgtcttttttaaaggttactaagatgattaaggagatgaaaccatttcaattggaaattagactgaacggatgacattcattgggcagataaaagaagcaagaagctgaaacctataaaaggttgtggacacaggccaggtgtggtggctcccacctgtaattctagcactttgtgaggccgaggcgggtggattgcctgagctcaggagtttgagaccagcctgagctatggggtgaaacgccatctctactaaaatacaaaaaattagccaggcgtggcagcatgtacctgtaatcccagctacttgggaggctgagacaggagaatcgcttgaatccaggaggcagacattgcaatgacccgagatcgcactgttgcactccagcgtgggacacagagcacgactccaactcaacaaaaaaggttgtggatggggtgatctgacactttttcaaaaaatgccaaagctttagaactacacagaaccatgaaacttttataaggtaactgaaagataagaaaatacagtgattctttacatcatttaaaaaataagcatcaagaactctataaatcactaataaatagaggtttaagaatggcttgggtaaactggtgggttagtaagtccataataagttatgcagctaggcggggtgcagtggctcacgcctgtaattccaacactttgggagaccaaggtgggcagatcacttaagatcaggagttcaagaccagcttggccaacacagtgaaaccccatctctactaaaaaatacaaaacaaaaactagctggacatggtggcacgcacctgtaattccagctatttgggaggctaaggcaggagaatggcttgaacccaggaggtagaggttgcagtgagctgagattgcgccactgcactccagcctgagcgacagagagacactctgtctcaaaaaaaaaaaaaaaatgttatgcaggtaaatcctcccatggaggtggttattgctccttccacccccgaacaccctctgtcgcttgggtaccctaagataccatgcttttatataaagcactgttcttgtgagaaatacgtgtaacctgtgttttttatgtttagagattttattccctcaaagttgcccccaaagttaaagccacagctgcgcctgcaggagcaccgccacaacctcaggaccttgaggttagtcccactaacttgctcgctggaagctatacatgccttactctccttggtaatacgaagacattcattatatctctactttattttaaatacagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctggtgagtatcttcacttcctcaagtgtttggaaatgctgtggtatcttggtcctgtgaaaaagaaaaactaagatcaatgtctttatattttgattccttgacctgccataacaaattaccacggactgggtagcttaaaccaaataagtttatcctgttacagttctagaggctagaagtccaagtcaaggtgtctaagccaagccaagatatcagcagggctgtgatccctctaaaggttctaggaaggcacaaatcctcccctgcctgttcctagcttccagcagttgcccacaacccttcatgttccttgacctgcaactgcatcactgcagtctctgcctttgttgtcacatggccttccttctgtctgtgtccacatttcctcctgataaggataccagttacattagatttagtgcccactataattcaatatgatgtcatcttaagtacttaaatctgcagagaccttattaccaaataaagtaacatgcaaatattctggctggacataaatttgggggggaacactgttaaacccagtactgtcccctaatgtaaaatgagaaaccacaagatatttgccacagagaagcactaaattagtatccatatgaatgttgatgttagagcataagaaatcagtaaacaaatttttaacaggaagtgccgcaaattgaaagaaaattaactctttttttcccatatacaagtctctttcagaatagactaatgaatccagtaagcttgtatttgacagtggaaattttacatgaatgtacttaatgtaaaaatgtatacttaagctttttgttgagccttgttttataattcttaactaaaaaggatgcaggaatttagtaaaattctttttaaatctgctcacaacagattttgatatagtgtgatgtttggcaaacttggcattgaaaagctacaaagataatcattctttctttttcaagacgacaaaaggagcttcatctttcaagataacccgtggaattgaagcagttggtggcaaattaaggtttgttaaataagtaatagaaaatagtgaaaatgccagaaaatattcaattttaagggaacttttctctgttatcaaggaggttgaggatttcttaagcaacataagaaggaaaagactgatgaatttgagtatatcaaactgtaaaacatctttatgtcttaaagtaaaaatttaagtaactgtctgggagtagatatctgcaatatataggcatacctcagagatgttgcaggttctgttccagaccaccacaatgaagggaatattgcagcaaagcaagtcataggaattttgtggtttcccagtgcatataaaagttatgtttacactatactgtggtctactaagtgtacaatgacattttgtcttggaaaaaaagtacataaccttaattttaaaatattttattgctttaaaaatgttaacagttatctgaatcttcagcaagtcataatctttgctggtggagggtcttgcctccacgttaatggctgatgactgatcaaggtggtggttgctgaaggtggtggtgactgataatttcttaaaatcagacaacagtgaagtttgctgcattgattgactcttccttttgtgaaagacttctctgtagcatgagatgttgtttttagccgtttacccacagaacttctttcaaaattagtcagtcatctcaaaccttaccacttttttatcaaccaagattatgtaatattcttttttatcatttcgacagtgttcacagcatcttcaaccaggagcagattctatctcaagaaaccactttgtttgctcatccataagaagcatctcctcatctgttcaagctttatcataagattgcagccattcagtcacatcttcaggccccacttctagttctcttgctactcccaccatagttgcagtttcttccccctctgaagtcttgcctctcagagtcatccataagggttggaattggcttcttccaaactcacgttaatgttgatactttgacatcctcccatgagtcacaaatgttcttaatggtgtctagaatggtgaattctttccagaaagttttttaatttactttgcccagatccatcagcgtcttcactatctgtggtagctgtagccttacaaaatgtatttcttaaataataagacttgaaaataaaaattactccttgatccatggggtgcagaagggatgttctattagcaggcatgaaaacagtgtcaatctccttgtacatctgcatcagagctcttggcattgttgcagtaataatttgaaaggaatcttttttctgagcaatgggcttaaaatattcagtcaaccatgctataaacagatgtactatcatccaggcttttttgttcatttacagagcataggcagagtagatttagcataattcctaagggctctaggattttgagaatggtaaatgacctcatcctaaagtcaccagctgcattagtccccaacaagagtcagcttgtcgtttgaagctttgacgccaggcattgacttctctagctacgaatgtcctggacggcatcttccaatgtaaggctgttttgtcagcattgaaaatctgtggtttagtgtagccaccttcatcgatgatcttatgtagatcttctggataacgtgctgcagcttctatattagcatttgctgcttcactgtgtactattatattaagaagatggcttctttccttaaagctcatgaactaaccacggctagcttcagacttttcttctgcatctcacctctctcagccttcatataattgaagagagttagggcattgctctggattaagctttgacttaagggaatacagtttgatctaatccagaccagtaaaactctgtattatcagcaataagtctgtcttgctttcatatcatttatgtgttcagtggagtagcactattagttttcttcaagaactgcactggtgcaagaggcctagcttttgacctgtatccgtttttaacatgccttcctgacttccttagaagcttaatcctttctagcttctgatttaaagtgagagacatgagactcttcctttcacttgtatacttaggggccattgtcgggttattcattagcttaatttcaatattgttgtgtctcaggagtaggaatatccaaagagagggagaaagacttggggagcagctggtcagtggaacactcaggacagaaacagcatttctttttttttaattaatttatattaaagacagggtcttgctctgtttcccaggctggagtggagtggtgcagacataccttattgcagccttgaactcctgggcccaagcgattcttctccctccgcttcccaagtagctaggactataggcacatgactccatgcctggctaattttttattttttgtacaaatggaggtctcactatgttgcccagactggtcttgaactcctggcctcaggtgatcctctcacctcagcccagcatgctgggattgcagatgtgagccactgcacccagcccagattttttatatattgtgttgtcagtggtaaagatgatagagaatgtctcattctgctgataggagtataaattgatacaaccacttaggaaagaatcaaggaatatctggtaatattgaaaaaccccacagtttttaatcacattcacaaaggtattctttataaagactggaaacgatctaagtgtccatctttagggaaatgggtaaagtatgacagagtcatgatgagaccactatacagccattacggaatgaactagatccatacgtcaacatagcacaactgaagggcaaaatagagtgtgaacaagcaagtttcaagatttctttaaggtattttaattttttaagcagaaaaatactatgtagtgcttatgattgtggtttccagagtgggagagagtgagggaattggtcttggaagggtacgaaaagatcttcaactttatttgccattttaaaaaattgtggtcaaatgtatataacataaaatttatatatatatatatatatatatatatatatatatatatatattttagacagtctcgctgtgtcgcccaggctggagtgcagtggcatgatcttggctcactgtaacctccgcctcttgggttcaagcgattctcctgcctcagcctccgtggtagctgggattacaggcgtgcgccaccatgcttggctaatttttgtattttcagtagagaccatggtttcaccctgttggccaggctggtctcaaactcctgacctcaagtgatccgcccacctcggcctcccaaagtgctgggattacaggtgtgagccactgcgcccggcccaaatttatcattttcttaagtgtgcagttaagtggcattcagcaaccatcaccaacattcagctccggaacttttctatcttctcccacctgaaattctgtacctgttaaacaatggctgctcattctcccctcccctcagcctttggcaactgccattctcttttcagtctctacaaatttgactactccaggtacctcataagtagaatcatacaatatttgtccctttgtgactggcttattatccttagcataatgtcctcagggttcatctgtgttgtaacatgtgaccagatttcactccttttaaggttgaattatttgctggtttttaaaaaaattttgaattttagttggttaatatgtggagttttgttatattattgttcgcaccttttatacttcagaaattttctttccaaaggaattggttgatagaagattataagggaaagcttactatcctgattcagatgatttactctagtttattttccgattcagtgtgaccgcaacaagggaaaacatggcttatactgtggaatgcctgcggggtgatgtgtaagtacctgtgtgtgtttaggacttctgctttgaaagaaatactaagctgctcacttctggtctttgtaatgcgtcattatgacctctgacttccattttggattattgttcataaactgctcaaaaacactgcttaccacaagacctaaagtttcacattgagagcattacagctatgtagaatctcaaatgttggctttacatttttgactcataattcttatctcgatgtcttctgtagtgatattctaatggagttcctgctcaatgtcaccacagcaccagaatttcgtcgttgggaagtagctgaccttcagcctcagctaaagattgacaaagctgtggcctttcagaatccgcagactcgtaagtacatttccagatcacatttgattctaagatactgggttttttagaagatcaatttatagaagaaaaaaaattgctgtcaaaatttttatttttatttttatttatttattgttttgagacagagtctcactctgtcacccaggctggagtgcagtggcacgatcttggctcactgcaacctccagctcccgggttcaagcaattctcctgcctcagcctcctgagcagctggaattataggtgtgcaccaccacacctggctaattttttgtatttttagtagaaacagggttttgccatgttggtcagactggagttcagtcttgaattcctggcctcaagtgatccacccacctcagcctcccaaagtgctggtgttacaggtgtgagccaccatgcctggccaaatgttttactccttgaatttgaaaatatctttttcaaaaatttgttatttagatttattattcttttgtttctaaacatttataatcatttttcatgtttgatggtaagtaaattgtttgtaagatcctagaagtttttcctgtttccttcccaatgttttgtttttgtttgtttgtttgtttgtttttgagacagggtgttgcttgttgcccaggctggagtgcagtggcacaatctcactgcagcctgaaccttctggactcaggtgatcctcctacctcagcctcctgagtagctgggactacaggcacacaccaccgcaccctgctaatttttatttttatttttttatagagatgaggtctcactctattgcccaggctggtctcgaactcctgggctgaagtgatcctcccacctcagcttcccaaagtgctgggattacaggcgtgagccactgtgcctgacccctagtgatttttaagagttgttttgcttaccccaaatcctacaccagtttattgctgctgctattattgcttactattgtattgctattattgtttagccatctcctctttattgagtctttccaaagtaagtaacttaatttttttaataggaatcttttttgcattcatattttatgtttatataatgtctaattatataatcttgacaagtacaactggtaatacaagtctgtaagcaagcgccgctgactcttgggagtcatacaacttctggtgggagcagaaatgtgcaggaagagcagaaatagctcaactcagtggttcagcatgggacaggctcccctccacatgcaggcctggggactgatgttatttcatgatgatgcttggtgtcacagaggagcattatctttgttgctcaggatttctactgaagaaatagatagaatagtacaattttagaaaagatgacctatgtgtccagagtggcttcttccccactggcggcagtgaggcaccagcctgcatctattctgcctgaacagttactgtgtagtctcctggctggtgtcagcctccaggtttacgtcttgagtccatctcccacacggccattacagtgatccttctgacgtgaaagtaagccttcttattatctatgggataaagtccaaacagcatatacgtatatggccttgcgtgatcttaccccagcccacttctcttactttatgctctaccctcttctccttccagctgcaattcccatttgaatcaaattattgttatactttatgcctttgttttgtctgcttcctgtgcctaaaatgctgttcccaaatgatttcccctgggaaacaccagctcattctgtaagatggatcccacatattacttgtattaattgttttccaattcccactgcccttgccttgtacctctactgcacttttgacacactgccgacattgcacccataatactttatttcacagtttttcctcttaaaatttgagggcaggcattgtatgttccacatctctgtatttctagcacctagcacagtgcctcgcataggcaagttgccaggtaatgagcaactgaaggaaatactgcaggcaaaaaggcattgaagcaagaaagcagggaaagcaccaagcaccacagaggagtaagtcccagtggaagctcccattggtcccctgaaagctacctgacaatctccttattacctagagaggaaacctaggagtaagtaaaattcagattaaatgacttgtccaaggtcacatggcaagatggcggcagaaccataactagatggggacttcccaaaacccaggccagtataccttccaagtgataccagctaggttaaagttagaaaagtggtttaggtggactccagtatatagaagctgctgccatgtaatcttttttatttttttctcagcacattctactggcagaaactggcagttactagaggttaaataataataaattttaagtcctcttaacatatgaatgccagaagatgaccaaatttgtataggcttgttgctttctaggttttaaaaatgttgtctttactgaaagtgcatttccctaaatgcttcttcacttatctcacagatgtcattgaaaatttgcatgcagcagcttaccggaatgccttggctaatcccttgtattgtcctgactataggattggaaaagtgacatcagaggaggtaccaataaaacatattttgaaatgtgcttgtttttcacattaaattgaacatctcccatttcaggtttgtttgttaatttttccttttatcttctaactttaagaaattcagcgtgctagctttttcatccacctgctttttaactaaaattttatctgaacaatttttgtgtctcctttaagaaatgttttcatgactaaagggacatgatcattacagaaaaattaaaaagtaaaatcaaacaaaatgaagggaaagaaaacatctcacatacctaaaggcactcagtgttaatacctggtatattttcttctaaaccgttttctgtgtgtatgtatcttttttgtttgtttgttttaaatacggggtcttgctgtgttgcctaggctggtcttgaactcttaagctcaagcagtccttctgcctatgcctctcaaagtgctgggattacaggcatgagccattgcacccagcctgtgtatcttttttaaacagtatttaaatgtttaagtatcataataggggctgggcccagtggctcatgcgtgtaatctcagcactttgggaggccaagacagagggatcacttgaggccaggagttcaagaccagcctgggcaacatagcaagaccctgtctctacaaaaaaaaaatatatatatatgtgtgtgtgtatacatatatataaaataggtcctttgactaaaactctttggtctctctgaatttgtaaataagacttgagcccacttccttagctcctgttccatcctcgctcactcattcacgttcttcagcacaccagcctccgtttgctggctataggggtttgtcacatgccacagccatatgtgcatcttagaactttgtttccaaaacatgaaacattgaatgctaaatctacaagtgtagatatgtgcgtataatcttaatttcctattcctaccacccagacccaaaaacaaattttatcaaaagacattaagagaaaaatttgtaattatcaacaccttcaaagtatatctgactcaaaaattcaaggtttttattctcgttttattcttagttagctgttacagaaaactaaactgtatcccttgctctttttgacttatcaattaacagtttgatgcctttcattcatatggcacttttatttagaaattttaacttacatcatccaacttgaacaggcagccgttttcataagactggactctaatgagttttgaaatttttcagaaatcaaattcaccctcatgaagatgtgtcattaagttagctaaaacttagcaaaagtttatctacaaggatggctattgtaatactagtttataattgtgaaaaattagaaacaagttaatatccagcattagggaactagttaaataacttatagaatggaacagtattcaaccattcaaaaatattagttgatacataaaactccacagcatgttgtcacataaagcaatttatggattaggacataccaaaaggtcccttttttttaataaaaggtatgtatgtatgcattatagacaaatatcaagatgttaactgtgataacttggttatctcaaagttaatagtattttttaaatgtgtccctaggctaaaggaaactctaaagaaattggcgctagaatacttggagcaatggcagcatcaatagaaaaacatcaatagaaaaagagtatgactttccaaggttactccataggtacagacaccattcattttagggcacggattatgataaattgattaaaagttcagtttcattactttagcccagtgattctcaaaacgttatcactttccttcctgaggagcctttctagccatttttttctaaacctcttacttttaataccacagatagagtttatgtgctgtatatttgtactttttacatagaagtcgtaagttttttttttttcttagttaccccaaaccaattttcacccatctggaaaggatagcatttctgttgaaagtacatgttttagccctacttttgtatattaagcctaaggtggtaatataaaccagtgataaccaagtctcaccaatcttcagatcgcctgagtggttgattggatggatgggtagttggtcggttttaaataaggattctaggattccacatttaatattttatatcagtctgtagggtaagtcccaagaatgggggacagtgaccgtttttgtttttcaagctgagtaattgtgatcttacagtttcgacaccctggtatagacaatgacttcatggtcagaaaagctttatagagattggcttcaaagatggacgagaagggtgttgtggtaaaactctgttagccctgttatagaatgttaatagtgcttcattactacttatataaacacaaaagaaacctgacatactacgtaagctacattataataaaaatcatagtccacgttttcaagtttaggccagtgtatgctctaatttctttttattcctttttttttttttttttttgagacagagtcttgctgtgtcgcccaggccagagtgcaatgacacgatctcagctcactgcaacctctgcctcctggattcaaacaattctcgtgcctcagccacccatgtagctgggattacaggcgtgcaccaccatgcctggctaatttttgcatttttagtagagtcaggatttcgctgtgttgcccaggctggtctcaaactcgtggcctcaaatgatccgccagccttggcctcccagagtgctgggattacagacatgagctactgcacccagcctctttttattccttttataaataacagctttgttgagatgtaattcaccatactatacaacctatttaaagtgtacacaattcagtggttttcattatattcacagagttgtgcaaccatgaccacaattaggttctagttcttttaagcaatagtttttataataaaatcccagggtaattcacctcagttagtaccttgtagttcattacagcaacttataaggccttataagtatttattttcttccaaactgtacttttatgtttttacagctttttatatttatgctaatataacctaataagtgtttttaacttcctcagttacattacttcgttcagaaccatttcacaagtgcaagaatggctttgattggacttggtaagtttagagtattgcctgcctgtcagtttgcttccttaagagcagttccttaaactgtaattacgtgaacataggattgaacaaaatttgaaaacttcggccttctatttatgtcagacaggcaatatatcataggattttaattgctagtcatttgttttggaaagcagaatccaacatttaaatttgtaaaccactggctttaaattctttacagtatttgtaaaacctgtgacaaaggtgaatttctcaaagcaaagagcttttacaaacttttttaaaaggaagtacagcttactagaaaaacaggcaaagggcatgaacagacagttcatgggagaaatatgtttgtatatgtgtagccaactatctttgttttaaatgatcagcctcactaataattaagaaaattttaatctgtgatgttggcaaaattaaaagatggactctgcccagaattaaccagggtatggagaaataggcactctcacaaattgttagtaggaatataaactagtacaacattttgggagatctttttgaacatatctgttaaaattctaggctgggcatggtggctcatgcctgtaatcctagcactttgggaggctgaggcgggcggatcacctgaggtcaggagttcaagaccagcctagccaacatggcgaaaccccgtctctactaaaaatacaaaaattagtcgggcatggtgacacatgcctgtaatcccagctatcggggggctgaggaggagaatcgcttgaacccaggaggcagtgattgcagtgagctgagatcgtgccactgcactccagcaagggcgacagagtgagactctgtctcaaaaaaatacaattccaaatgtttacactcatagacccagtgacttttaagaatttgtcttacagaaacattaggtcaagtttacaaagtagttgcatgagaatatcatttgtaatattttttgttttgttttgcaaattacagcttaagatataatttacatgctataaaattcacccttttgaagtgaatagttctgtggtttttaacagattcaactattaccactacctaatttcagggtgtgttcatcatccccccaaaagccccatacccattagcagtcactccccattctcatcttccccctgcctgtggcatccactaatctactttgtttttgtttttttttttaaagagatggaggtctcattctgttgcccaagctggagcacagtggcacaatcatagctcactgccttgaactcctaggctcaggtgatcctcccacctcagcctcctaagtagcaataatctactttgtctctatagatttgactattctggacatttcctataaatggagtcatacgatatgtggccttttgtaactggcttttcttacttagcataatgttttcaaggtccgtccatattgtagcatgtgtcaattcaatgtcttattcccttttatggctcaagaatactccattaccacattttgtttattcattgattggcatttgggttgtttctaccttttggctgtcgtaaatataaacattcacgtgtacatttttcttaggaaacctgtttttagttcttttggttatgtctaagaacagaattgccaggacatatggtaactctgtttaaccatttggggaactgccagactgttttccaaagtagctgcaccattttacattcccaccagcaatgcacaaaggttttgatttctccacatcctcaccaacacttatcgtctgtctttctgattatgaacaacctactgggtgggaagtggtcattgtagttttgatttgtatttccctaatgacaaatgacattgaacatattttcatgtgctttttgtccatttgtataactttttttgtttgtttgtttttttgagacagaggcttgctctgttgcccaggctggagtgcagtggcgcaatctcagctcactgcaacctccacttcccaggttcaagcaattctccggcctcagcctcccgagtagctgggattacaggtgcatgccaccattcctggctaatttttgtaattttaatagagatggggtttcaccatgttggctggactggtctcgaactcctgagctcaggtgatccacttgcctcggcctcccaaactgttgggattacagatgtgagccaccgtgcccagtcaactttggagaaatgtctattcaagtctttgcccatttttaagtttttttttttaattgttgagttgtaaaggttctttatatattttggttactcaagctgttagcagatatattatctgcaaatattttcctgcatttcatgggtcctctttttactttcttgatacagtgttctttgatggacaatgcaatgttgttttaagagctaactattagaaacatgctagcgtccattaggaggggattgatcaaataaatggtggtagagccatagaaagggattctttataaccattaaatatttgatgtagactactcacttagaaatttgtaaattatgaaagataagttagaaacaatatcaatagaatgataccattttagaaataaattgaagataatattaactacacagaaaattctagatgaatagtaatactaagtatatagtaaatagtttagtaatagtaaactgtaattgggtatctctgggagagtggcattatggcaggaagactcttatttattttgtagtgttaggattttacaatcgtatttttaaaacaaggaaaaaatattttacgattgtgttttagtaattgtggttctagctttgtttttgcttctgttgaaacaggtgtgagtcatcctgttctaaagcaagttgctgaacagtttctcaacatgaggggtgggcttggtttatctggtgcaaaggccaactaccgtggaggtaagcatttcattctattagggttaatttatcagaagggcgtttccccactagaatagcatattgaggtggaataggcctgaatatttactactgaacagtctcggcatagaattggatggcttgggtgttgtattttgagcatatgttttgtgtgtgtttggggacaggatggcatggggaaagcaccgagctgcagaaaagactcgtgggttaatactgtgttgtaggaaatactggagaatgaaaccaatggtgaacaagccattttcttcttccctctatccttaatctggccccaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtgagtctgaacagttggtatctctctttttgctttcaaaggctcagtatttaagatataattctgataatctactcttaaaatgtaagacaaacacacagaaaatctttgtacaattgaagagatagccaggcttgattttagtatctttgaaggcctatcaaaaactcactggcttttccactttgtctattacttgtcattagtaatataaaaagaggaattgaatgcttagaaataaagggaatccacacatccgttccctttagaataaagttgtagatattaaactttcccctagattctaactagtctttttttctagattttcttctgtccgcttctgttcttttggttacttcctgaatctcactatttgttttccaaccaagtggacaagatgaacaccaagaaattgtttacagactcactcattcagcttgagattaaatttgaaaagaaaaatgagaggctgggcacagtggctcacaactaaaatcccagcactctgagaggccgaggtgggcggatcactggaggtcaggagttcgagaccagcctggccaacgtggtgaaacccccatctctcctaatccaatgaagtaatttaatagaaattcctagttcagaactcagccagaaatttagagtataaataggatggcctcagaattataattaaagaaattgaagtccaggccaggcacagtggctcacgcctgtaatcccagcactttgggaggccaagttgggcggatcacaaggtcaggagatcaagaccatcctggctaacacagtgaaaccctgtctctactaaaaatacaaaaattgtctgggcgtggtggcgcacgcctgtagtcccagctacttgggaggctgaggcagaagaatcacttgaacccaggaggcggaggattcagtaagctgagatcgtgccactgcactccagcctgggtgacagagcaagactctgtctcaaaaatatatataaataaataaataaaagaaattgaagtgccttcttatgctttacgtggactgagccaatggttctccaagtttattgtacataagaattacctggaacacttgttaaaaatctgggcttccaggctgcatccacagggacctgagtcagtaggtccattttgggaatctgaaagtttgtatttttaataagaacttagataatttttatgtaaatggtccacataaacactgcaaatcgggttcaccctagagagctaaaagctctgctcaaactagataacaatatccctgttattcagaggttaaactcttgatagcttggacatctggataatgaccactaagcagaaatttttctctaactttctgacatgagtgtataagagaaatgaaagtaaattggtgaaaaagtccctaccaacagcagagagaagaaacctggtctgcctaatgccaaagcctatctatattataataataatgtttgcagattagtgtttgcataaacctttaatcatctaaagcaggttagaaaatacccagcataaaggaaagggagcagtcattttagaaatatttaaatgaaaaaacaaagccgtgatagttctgaaagaggtaacctatttacagaatacttcagttcgtgacagaactggctaagtaaaatattaatctattttgtttataccgtgaaggtccaagttttttctaggcaaacttaaagaaatcgtgccctgttttacttggtagaatatcatacagtaaagtctcattatctttcaggtttctgcatttaatgccagttactcagattctggactctttgggatttatactatctcccaggccacagctgctggagatgtaagttgcaaactcaccaaacttctttcatgaacaagttatttctcccccccgccataaacatgttttcggttaaaatatggaatgtttgaatgcagtgcaatgacttatcagagctctgtatagtatgatgtcattgaagcattatctgctatagggaaatttacacatgtatactaatgcttccaggaaagaggagagaattgcctccttcatgttttggttctggttggacaagttgcattgagttggctctgagacatctaaattgagaacccaggagaggggaagaccaggaggtttatttgcaagtcttcagtgtagagattgtgttgaaatcagggatatgtgtgaatgattgtaggaaaagaaaactaaagctcaatttctgggaaacaacaccatttaaggagcaagtggctaagaaaaatggcccaggtaaacagaaagaaaaagagaagctgatatatttgaaggataggaaagagagtatgtttaacaccattttgacccacagtgaaataacattcattaccactgagaagtctggtagtttcagcaagctaggacatcatgggtgatcttaacagttttgactagagtagtggaaattgggtaaaatgtgtagtgattaaggaatgaatgacaagtaagaaatgagaggttggtgtgggctagtggagcttagacattcaaggagcaagttgttttaggagagtttacactgagagattaggttgaaagagacatactgagcaaaaagatcggagcagatatcggagatagaaaattataaatggctcaagtctgagaaaggaatacttgggatccagcacacaagtggaccttttagccttacagacaggctaatattggaagatattgggaagatggggaagtacctcctcagtgagacaggaggctaagtcatgttttgacagacgtgagaggaaagtttaaagaaagtagtgaagtttgggacagacaaatagtgaggtacacaaaaagtgggtattcgctgtagtgtagatgtatccttgaaatcagcgaccacaaattcatagtacagtcagtcagcactgtcatgtaatttttcttcagttgcattcagaagcctaatagagaaatggaggaggtaggtattagggttaatcccaggttggaatcctgcaaagtgggcaggtgagaagtatgaggagatagcaagggagttgggagcattggcaagagtgattaaaaggatgattcagggatctaggctcaatagagaagtgaagccagagggggcctgataaattgaaagactggacaagtcaaggaactagagatcttgataaagtggaagaataaggatagtgagattaaagactgaggtcggggtcttagaattgagggcttcagaggtatgcaaatttaggctatgatcaggtctggggtgtggctctgaaaatgggcagctaaaatgaaggggaaacagaggtcctagaatttaggtgatcagagggaaaaataagtagcagacccagccagcactgggatggagaaaatcatggtcagatttatttatttattcaacaaatatttaccaagtacccacatccccggaactttattctttctttctttttttaaataccatacaaggattcagattccttcttgaccctggcttacaaagtatggacaagccttacaaattggctgtgtatggattactactctcttcttagtgaatagtaagagatagcagtattaatggcatgacactgcaagagtctggggaagttttaaaggtgcttattctttatgggtgattagaaatccatgtgtttggccgggtgtggtggctcacacctataatcccaacactttgggaggttaaggtgggaggatcacttgagcccacacatctctacaaaaaaagctaaaaaattagccaggcctggtagcatgcacctgtagtcccagcttcttgggaggctggggcaggaggattgtgtataaacagctgctttatgaacataggaagaataaggaacccatagtgatgacagcattccgcatggacactgtgctgtttgtctggaactaaccttccatctgtgtttttgcctcagtaaagaagtgtgtcagtgctgcaggagactctggtactgaccacagatgaccaacttttcttatctgtcctaggttatcaaggctgcctataatcaagtaaaaacaatagctcaaggaaacctttccaacacagatgtccaagctgccaagtaagtctcagtattaactgtgttttatgtttttgttatttgaaagttgtattcttttcagattataacaatattacaatctatgctcataaggactgagaagtacagaaaagcgtaaaaagggaaacatacccatatcctaccacctaaagatataattgttaacattttggccaggcacagtggctcactaatcccagcactttgggaggccaaggcaggtggttcatttgagaccaggagtttgagaccagcttgggcaacatagcaagacctcgtctccaccaaaattagagaataattgttaacatttttcttagtttattgatcatgcatttttaaacataattgttaatattgtatatatagatgctgcttgacttacactggggttacgtcctgagaaatgcgcatatcgaaaatgcatttaataccctaataacccagtcatccagccaaacaaacataagtcaaaccatcataagttaagttagggaccatctgtatacttttttatcttatttaaatagcatccttattatagaagtttgaaaattacaaataaaagacaaaaatgatctctgatttccctagcaatgattctgtttccattgattcaaattactaaaaatttaaacaatattcattggtgtgtcaaaatacacttgtgcattttctgcagttataaagatatctttgggcttaaaatatttttgtgtttcgtattactttcttggtgtagattcccaactaagttaagagttataaacataacgaaagactccatgttagagtgtgtgtatgtgtgtatgtttaaataatacatttgactaggcgcagttgctcatacctgtaatcccaggactttgggaggctggggcaggaggatcacttgaggccaggagttcaaccagcctgggtaatgtggcaagacactgtctttacaaaaagatatttaaaactagccaggtgtggtagtgtgtgcctgtagcctcagctactcaggaggctgaagaggggggattgcttgagcccacgagtttgaggctgcagtgaactaagatcacgccattgcacactagcctgggcaacagagcaagaccctgtctcttaaaaaaaaaaaatgtatttctaagtcacaaatctaaagagattgtaccagtttataatcataccaccagtatataagagtacctattctacaatagtttctttcttcataactaatttatacccaaaaaagatctgattttgttttgttttataagaaagactaaaatacttgtctgctatttggcaatttataaatccccactgtccagattgaaagtgctatcaacactcctaattcattagtagttcgagggtttctctaaaagagacagacttgggacaaagttggaaatcaacctgcattttcatacagccgcttaagacatttaagtttgactccatctacttagaacaattcaaaatgtgaatcttgcaactccagtggtcgttatgatcatttagtattgcccacaggggaagcagaattacaacccaggatggaacaaccttttggtcatttctgttcccattagtattgttagttttgttatgctgagcacactacaaagttgcatctcttgtataagtacaacacaatttattaaatattgtatacatagaaccaagaatcgataggatgcagggctgcttgattgtaccagaaacaaaacatgatgagaatacattgaaacactggatttacttaagaaaaacctaagtttttcaaatctaatttatttaagaaaacgtattttcttaataagtgtaacacagttcttacaaggtatggtaataagcagaaagtagaattttgaatattaatgtcaaagtatgttttctgccattttgatggagttgatactttttcttgtaagttcttcctgtagtgaaagagagaaagtgaggtgtcattgccgaaaggacacactaataacctcttggtagtttattgcaggtaaaatcattttttaattaagctgacaacgtggtaaaactgcagcattaaattgtaattatgtttaaatggaagtctttctgtagagtgttaaaggatgataaacgtttgaggttcaaataactcgactgtcttatcaaacaccatgtctataagtaataagtttctgggagaattgtgaattggattttgttttatttcaagtggatgcttttgtgcccatatttaagctgccgttgcttacaagacctgtactgcccttccccacctgccttttccatcataccctatgctcacagacaaatctcagcaagaggcaggagttgcttcactaatcaaaaccttacattaaaatagttttacctagatctaagttctagtcccaaatcaaaaagcaatctgtggagttttcagtataatttcgtactgacagctttccaaatagtaacgtaaacggttcacgtacttggtgaactgaagaaatagaatggaggccattagcactgtaagttgttagtttgcctgtttaccaaaaatatgttgagtttcggggcacataccttaaaattgccctgtttcactgtgtaagaggaactggcttgactacttcacccttggtgaaaacaaacaggccctaaaagaggcagcaacagctgaagtggatatcacagaaataaacagacagcagaagctcttcagacacccccgaaacctgccaaaactcacaggtaatacaagtgaaacgatagcataagaagaaaataaacatgagaatcttcaaactacaagcattgaacggtatcctccatccaagaagagaacccacttcatacaaggaaaaggcaaaaggaaaaggtcaagactgtgacctttataacactgtgaccccagctgtgggccaggtggagttgtctgtggtgacaccaagtacaggcctgacaccctggtttgacagaaggctcttcaagatccctggtcttcacactgtagcagccaaaaggtaggtttacaatatacactgtccccaacttgccatggatcaattataatttttcaacttgactatggaggaaaaccatcgcaatttcagcttccagtcatgggtcacataacgatggggatacattctgagaaatgtggtgttaggtggtttcatcactgtgtgaacctcagtgttcagacaaatctagatggtatagcctactacacacatgggctctatggtatagtctattgctcttaggctacaaacctgtatagcatgtactatagtactgaatactgtaggcagttataacacaaaggtaagtatttgtgcatctaaacataggaaaggtacagtaaaaatacagcacaaaagataaaaaaatggtatgccatttttatggcatagctcctgctttcgagtgagtcagtgagtgagtggtgagtaaatgggaagggctgggacattactgtgcactgctgtagatactaaacactgtaaacataggctacgctaaatttatttttttaaaattgcactacaacattatgttgtcagtaagtaataggaatctttcagctccctaataatcttaacgggaccaccatcatatatgtggtccatcattgaccaaaaacatcattatgtagtacatgactataccttgaatttcgatcttttcctaggctagtgatatgcagtacatgagataatcaatgcttccttacaaaatgggcttatgttagaagacttttgcccagctgcaggctattgtaagtgttctgagcacatatgagataacctgggccaagctatgatgttcgatacgttaggtgtattaaatgcacttttgactgccatctcagtggatgacagccttctcactgacagcagagagatcttcctcactgtgccagtgggcaggagaaagagcatgctgcgactggccagtgacatgcagaggatccagattgcacaaccggatccagaggccttgggaagcattagggagctctccagctgtctcactcaaatctgtagcagcatatggacccacaaatggaggccaaagtgggccctcaattggacactttggcaaccctgaagagacttcttcccttcagacttactgttttagtatgttccagagaagggagtggcattcttcttggggaattcaggaagagggagacacgctgttactctatccattaaataaagctttgatgttcacagccccccgccaccactcagaaaaaaaaaataattgccttgctctctaaaactgacttctgccttttattggacaggaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgtaagtaaatgaaaacttaacgatttaacaacagagaacttaaccttaatgatccaatttcagaaggatgcataagcgtccttgggcagtgtattattcttatgtttggtgctcatctacttaatgtggaggcaggagggctcattcccataagatccgcaacaagcttccctgtcagctcgagtatatgtatcttcctccttcaaataaactaccattaggttaaactgtgatgtcagtaagagggctgccatccactgagatggcagtcaaaagtgcatttaatacacctaacgtatcaaacgttaggttaaactaatggtagtttataaaatgggcttatgttagatgactagaagtaaagaagagtcaaatattagcagtttcatatgatccaacctaaatagtgaagtttgctatttttcctcttcagtcctagcaatatttcaccatctagcatcttaagattttctttactcttctcagcctaggacattctcttgttcttgctaatttttttttcacatatattattgttccctacaatattgagctgttttgagggcaaggactatgtcatgtacttctttgtgttccctgctgtgcctaacaagcacatgacctacagaattaatccaaagtaagtgggttttccccattttctacattaaacttgccaacttgctttctactgtagatgtctcggccatcttctcaccaacaggtctaccttgtatagggacagtggggataagaaaaaataaaaaactaagctgggtgcagtggctcattcctgtaatcccagcactttggaaggctgaggtgggcagattgcttgagcccaggagttcaataccagactgggcaatgtagcaaaaccccatctctacaaaaaagtacaaaaattagctaggcttggtggcatgcgcctgtagtcccagctactcaggagctcatggggctgaggtgggaaggtggcttgagcctgggaggcagaggttgcagcgagccgagatcatgccactgtactccaggctgggcaacagagtgagaccctgtctcaaataaaaaagagacaaggctattttaagatagtaaccctgacttgatttcacttcgccccaatcgtcatttcatactcttcttttttttttttttgagacggagtcttgctctgttgcccaggctggagtgcagtggcgcgatctcggctcagtacaacctccgcctcccgggttcacgccattttcctgcctcagccttcctagtaactgggactacaggtgcccaccaccacggccggctaattttttgtatttttagtagagacggggttttaccatgttagccaggatggtctcgatctcctgacctcgtgatccacccgcctcagccttccaaagtgctgggattacaggtgtgaatcaacgcgcccagcccatttggtactcttttaaatggctgtcttcatcttatatcctatcattatgtgcgtcccaacccgactgcttccaccaccacctctccttcatagtaataagataagctggcctgacagaatatgggggctgctgctccacctacacctgactcatgatactacacttaaccagcctttgaacttggaagtagtggcataaagaatcctctagggtatcaagttttacttttaagttaacaatcaatgtatttttattgacccagactatttgccattgtaataccgaaacaggaaagtatatccctgcctgaagccacactactctatttgacagtgtcagtgttgttttccttatctctctttgaacagctaccctcttaccagtgttgctcttgcttggttcattacacatacaatgggactttcagagaaacagctaagcttttcctcccacactgtcccaaattaaagcaccagccatctcctagttaattttcacaacagctattatagtaattgctggcttagaatgtcctatcgaaggccaggttggtggctcacgcctgtaatcccagcactttgggaggttaaggtgagtggatcacttgaggctaggagtttgagaccagcctggccaacatggcgaaatcccgtctctactaaaaatacaaaaattagctgggcatagtgatacatgcctgtaatcccagctccttgggagggtgaggcagagaattgcttgaacctgggaggcggaggctgcagtgagccaagatcgcagcactgcactccacactgggtgacagagcgagactccacctcaaaaaaaaaaaaaaaaaaaagaatgtcctatccataaattcttgaaatgacaaaataagttcgcctgcttgatgatatatatttttatttttgttaattttgtcttttgtttgtttctttaaaggcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacatacatttcctatcaatcatatcctatattcccattcattcatttttttatgtctgatttatcttcattgacagagttttgtttttctctcatctcctgtctctcccttatctgttactatcctgtctcttccaaataattaactctcaattcaacatttacagtaaaagaagggctaaaaaggggaaaaaaaaagaattctaatgtgaataactagccaaagaattatgtctcttagttattttaattatagtacttgaagtttaccaaaaaaaagagagaaactaaatatttaaagaaaaatgtagtgtttacataaagtgacattctctactatgttcagacattctgatattggatttctctacggcattttctaaaagaaagaaattcttctcaaaaaggagggtcttattctgaaaataagatttgtgaggcctgcaagaacccaaggaagtctttagataatcctgttgaagaacatctctaaaggctttataacgcagtcataagagaagagaattggtgagtctacagacagtccttgataagtacagcaaacttgtgcctggtgaggcacaaaacttgggtgtctgcaagataaatgctcatatgaccacagatttgctaaccaacctttgataccagttgggctttaccctcttcaacttgggcacaatcttccagccaaaatgcatctgaggtagaggaggtagaggaggaagagctttcattgtcttgcttcaccattatccagtatggagaaggggccctcacttctttcttgtcgtctctgtgaatcatcacgtcacaattaatgtcttttcctacactaatagtatggttcttcttcttatatccatgccagtctctggagatggatattggtctccttgcagggtgatgcacagttgaccacggatatctataatattgaagtcttttatctaaatctacattttcattatcatcactgcttgtgaaagattcatcttttgccagctcaattttctttggtgtgctgaaatgaaaagaatagtgaataaaatagattcttcatgtctaaacatttatggtcccctaacaagatgccttataacttgctttgactcataaaagatacaatttagctttagcattacctttctgtgtcattgaaatgtttctcttttttaaatcgtcttgaaatctttttccatttctaaatggaaatcaaattctgccttaaattacttcaccataccttaaaaagttttgcacagacttatactagactactgaccagaatattaggaggtgttaaagggtaggttaatttcactgcagctaaagtgacggattcaacctggccatctcctgagaactctattcttgtggctcacgtggcattaacacaacattactgatttccagaggagtcaggaagtcaggaaatagtgggccttaaggatcttcaacatcctagtcattagtaagtcttagagtcttttttttagagagggtcttgctctgtcacccttgctggagtgcagtggtacaatcatagctcactgcaaccttgaattcctgggctcaagtgaccctctggcctctgcttccaaagtagttgagactacaggtgtgtatgctgtatgccaccgcacctggctaatttttatttatttttatttatttatttatttttaaaacaggatctccctatgttgcccatgcctgtctcaaactcctggcctcaagcaatctttactttggcctccaaagtgctaggattacaggcatgagccactgtgcccagccaggtttttgttgttgttgttgttgttgtttttaactttctccaattattgactttcttgattgttgaaactaggtggtgcttgcctgctagcacctccaggtctctgaactttcctaatgcctacagtacctgtgcttgctttaactttccagaatgaatgctctgtcacctgctttccctcatcctggtgctattgcccagcagaaccaaaactagatctttgtgattacaaatctctggtacattctgccctgctaaaaggaaataggtttcttccctgccaacctgttaagacttctggtgttatcactaataaccttggcagtctgcctgttgtatttgcttccaataatttgaatggcttttccaaaagtttatctcttccagtaataaacagttgataatgagtaatttttactgagagccactagtcttaaatactgattttctttgtctgatttgccttcagacacacctaggtcttcctgaacagcacatgaattttttttttaaatccaagtattagtaacttttttttttcagactgcagggggaatccttggcaactctgatggttaggtaaccataaaggacaggtaaattgtcattaggtaataaagccacaaccctgcagaggtcaggattggctagaaacaaactttctataccacttggcctacccagagcgttacatggagaatttctccagtgtgtatacccagtgccattttctcctggaaaagtttatactagctttgtgaaagcatctttttccttcttctttccctgccgcgttatacataagttactaaaatgcctcagatatgggtactttgcctaattaagaaagggaatcagcaggtgcttggtattgtttgtgggttttcgcctcttacttaagttgtactgttctatcttttctttgcttttgaatggtcagtctaccatccttagaatttaatattctggatctcaaaactcctccatgtaatgaaaatgcttagaacatagttgttatgtaatcacatgagcccaggcttttagagtcgtgccctccagtgtaggagtcgctgagtaggatttgattgtgagttgtgatcgtgctactacactccagcctgagtgacagagtgagaccctgtctcaaaaataagacttttaaaattaaaaattaaaaacaagtgaaccactgaccacatgaaagtcctagggcaattttagcaaaacaagacagactcagtccctgccttgatggagttcacattctcccagggaaacacagtgaacaactgattacacagattatttcattaaaattgggataaatgtgaaggagcgagctgtgagagcatatgtcaggtggacctgtttctaggaagaccccttggagaagttacactggagccttcaagggtgactactgaagagcaaagttacaaacatgttgcacacagagaagagcaagtgcaaagaccctgaggcaaaacaaaaggcagagagctggaagctaaagggggctagagaaggatggggaaagcagtatgagttgaagttggaatggtttgcagaggccagctgaaccccatagagcatcattggccaatgtgaggattttgacatttatccaaagaacaaaaagtcttaagagattttttgcaggaacatgccaggatcagatttgcattacaaaaagatcattctggccaggcttggtggctcatgcctgtaatccaacactttgagaggccgaggcaggcagatcacctgaggtcaggagttcgaaaccagcctggccaacgtggtgaaacttcgtctctattaaaaatacaaaaattagctgggtgtgttggcatgcgcctgtaatcccagctaccctggaggctgaggcaggagaatcacttgaacccgagaggcagaggttgcagtgagccaaggtcacgccactacactccagcctgggtgacaagagcaaaacctcgtctccaagaaaaaaaaaatacagttttggtgataatacagtttgaaagtaattagcatgtggatagtcatagaaaccacaggcatcaatgaaactggctaggagaaaggacaccaagaggaaatggccagaggtaacaggaaaatcaggggagtgtggtgtcacagaagcctgggaagtgctatttcaagaagagagtgggtggaaattgttaagtgtctaatgctgctcagaagccaagcaagataaagacagaagaatctagtgggatcagaagtgtgaaggctatgggtggccctgggaaaaggactcagccaagggatgaaagcaaagcctagattgaagtgggtggaggagtgtctgggaagtggcgtctttcgaggaaacagaggtgtctaatacagcttttagcaagttgggagtggatgcaaaagactccagtggctaaagagggtagggagaggagagtggactgaagataggatttgccaagatgggagaagtttaaaaaggcttagatgttattgggaaggacccagagaacaaaaagttgaatacggaaaagaaaataggatttgcaagaagcactttttttttttttttttttttttgagacaaagtctcgctctatctccaggctggagtgcagtggtgcgatctcggctcactgcaacctccgactccctgattcgagcgattctcctgcctcagcctcccgaatagctggaattacaggcacgcgccaccacatccagctaatttttgtaatttactagtagagacggggtttcaccatgttggccaggatggtctcgatttcgtgacctcatgatccacccgcctcagcctcccaaagtgctgggattacaggcatgattcaccacacctggcccacaagaagcatttttaagggctgactcgggaaagaggggcaccatacaggtaggcatggggacaaaattcccaaccgatgacttgttttttaactccaggttgacttcatcgtgctttctcatattagatcctacagatctaataccagaaacccaggaaattactctgacagtgtcaccagtcctcctgtcatgatccttatcatttgataattgtcacattaaaccatctatgcctcacaggccctgggattctgtattataacaaagagttcctaaaatgaactatttaccttgttactgggaatttggcctcagggattaaatcatatatttcttgccattcttcaggaatgttaataaaatctcggtaaaccttgatttgtagcactgttccaatagtgatatgttgcaaaagctgtaaaaattctcgaagagtatatcctaacacattggcatggccaacactaatcagaacatcacctgaagagggaaaaaattatgtatcagtaaaactagaggtttaaagggactatattgatttctggctttattgtgaggtatttcattttatgggttcatattgttgattctttttgaaccaaaaccaggcttcagccttttttttttttttttttttgagatgaagtctaactgtcacccatgctggagtgcagtggcatgatctcagctcactgcaagctccgcctcccaggttcaagtggttctcctgcctcagcctcccaagtagctaggattatgggcatgtgccatcaagcctggctaattttgttttttttttttagtagagatggggtttcaccatgttggccaggctggtctcaaactcctgacctcaggtgatctgtccacctcggcctgccaaagtgctaggattacaggcatgagccaccgtacccggcccagcctttatttaataaagatgttcatgtccatgatatgaatgtcctttgcatactgaagaatgtatgcaagatgtttcttaatagcagtatattggtagacattatatgatgtttttgagacgtttctgaagttcttggtgtgacagaggctaaaaaacatttataatcggaaccagctgttaggattctaaaaatagattagtttcagataaaatgaatggctattactagaaaagaaaaaaccacttacactaagtggtgaataaatgacctactttctattatacctgcctggcaatttccagtgccctccacagttaatagaccatattaaacataaagcctttcattttaattctctacccttgtgcagtattagttgagcaaataattctgtataaaacattgggcaattaggcatgctttaactgtaagatgtgtatgcagtgagtatgttggtttaaagggatttgacagctaggtttccctaccttagggcaacgcaggataaggaaagaaacaagatgggcaaccatgcagcttccgagtccctggcaggtgggaagaggactacatcttgagcactaacccccgaaacccccaaattgaaggaagctaaaaagaccaatttttcacttgctccaacctcccccatgtccccacctccagcagctaggtcatggacctgtgagtgagatccagctacttgacactcccacctgggtcactgaacctggaggaggagatgcaaaagagtgacaggagcttctagttgctaggggtagttacacacagctcttggttctctcaccattttccaagcctgcttctccagccttttgggagattctgtcagactcagtatcccaaattcagtgcattaacagaagtgttttctgttttttgcaatgaggaaccctggctgctacaacggcattcagcaagacttcagaaaggaatacaaaggatttgctttttaaggaccagctcacattgggcaaaatcttaagtcttcagatcttactagtactgaccttctggagaccctcaatcagcctcattctaagacagctgaagcctaacctcaaagaagaaaagggtcaagaagtgccttctctgatgcatgcactgggcttcaatcaggaattacactgatcccaaaagaagcctctaaggatgccaaggacaaatgtccatagctctagatcctatcagaaacaaaagttcccagaattccagaaaacaaatacttacaagggtggagaaaaaccttctactttggtcttaagcagtagctgggggtaatacaatcaaccatgtatctgaagctcacttcagaatgaaacaaggctacctgcagcttgagcaatatgaaacagctgctcatcctactgaggttaattacaatggcaaaacaaaacaaaacaaaacaaaaacaaaaccctccccggatgagcttacttacctaatgttaaaagcagtgtttatagctgaaagctatggcttggcattctgcttaattatgttgtaaaagtgtgacttttatcaagagggcagaaaataaacagcttaatttcctgaccgttctggctgtaaaccaaacatgtcagcatgtgaatgtgattactctagcaatagatattaacattgcccttcatacagaaacaccaatttcgtacttatgaacaccaacctcattacacctttttttttctgttttaatgggctataggatgacattatataaactttgtctcgattacctacagtaaatcaactttgcagcagccaagccactactgaaaaatattttatctttttcatctctcccaactaggctggaagttccttaagttcctcaaggctaaggaccatgtctgtgccgttcaccactacacccccagtgcctagctgggtgtctgcacacaccaggcctttaggaactgcttaggcagtagccagtccatgacttgtatttactgttgaagctacattaatttctttttttttttttctcctgagacagggtctcactttgtcacccaggctggaatgcagggatacaaatacagctcactgcagcctcgacctccagggctcaagcaaccctcctgcctcagcccctggaggagctgggactgcaagcgcatatgcccaccatgttgggctagtttttgtattttttattgaaatggggttttgtcatgttgccccagctggtctcgaactcctgagctcaatttgcccgcctcagcttctcaaagtgctgagattccaggtgtgtgctatcgcacccggcctacattaatttctcaagacttagaatgtcagaatctgttaaggccatactgcccaaaaggaactaaaagtttagccagaataaactaacactaaactaaattaggaaatcaaggtgaaaccctatcctgaaacaccaaaggagagaaatttcagcacatagataaaagataatggggctgggaggaaacggggtcaaagaaatagcatgtttctacaattatcatctctcgagatcttatcatcattgtctaaaaccactgagttacagattttaaagcctagaatgatgccgaggagaactggcaggcttgtcacgaagagatttggggctctggacttcctctgtattcaaatctcatttctagttgttaggcaattgactagaaaggtatgggctttctaggcacacatcggttcaaatcccagctctgaacacagactcagttgtgtaactaagatgaacaagttatttcatctctctacgcctctgtatttcattatctacatttcaggagtgttgcaaactttaaattagataacacgtggggccaggtgaagtggctcatgcctgtaatcccagcactttgggagactgaggcaggaggattgcttgagcccaggggttcgaggctgcagtgagctatgattgcgccactgcactcctgcactccagcctgtgtgacagtgagaccatgtctcttattcaaataaaattaaaaattggagttaaaaaaagataatagatggggaaatatctcccacaatgcctaggacaaatatttattatttatttattaagcaaagacataacaaatgagccactactttaggtgtgacggttaatattgtcaacttgatcggttcaaaggatgcaaagtattgtttctgggtgtgtctgtgaaggtgttgccagaaaagattaacatttgagtcaatggacttggagaggcagacccaaccctcaatctgggtaggcaccatccaatcagctaccagcaaggctagaaaaagcaggtggaaaaaggtggaatgagcagacttgctgagtcttccagccttcatctttctcctgtgctggatgcttcctgccctcgaacatcagactcaagttctttggcttttggactcttggacttacaccagtgttttgccagggtttctcaggccttcagccacagactggaggctacactgtcggcttcccaacttttgaggttttgggactcggactgagccactattggcttccctgctcttcagcttgcagatggaggggcagaacaatatggtttggttctgtgtccccatccaaatgtcattgccgattgtaatccccacctgtggagggagggaggtgattggatcacgggggtggtttcccccatgctgtcatgatagtgagtgagttctcatgagatctgatggttttatgagtgtttgacagctcctccttcacacactcacactccctcctgccgccttgtgaagaaaatgcctgattcctcttccactatgattgtaagtttcctgaggccaccccagccgtacggaactgtgagtcaattaaacctccttcatttataaattatccagtctcaggcagtatctttacagcagtgtaagaatgcactaatacagtaggtgagtcctggatttaaaagatgaaattcaagactgcttctaacctcaaagagcccactaactatagccgtgccatgagattctctgttgcccacctaaaagcatactcctgtcccactctagcaccctggagtatgcacccggatcatcacccagcatctgtcacctgaccttgaagaagctgagaagcagcagcttccccatgggacctgtcctggagttcttttgttctggtaagtccagaactctccaccggccgccgtttattctccaccaccaagtagtgatgtgtggggaaaatgctttggattttaaggtatagcaaactgtttcataaaaccattatgtatctgctttcttctttaatccattgcttggaacccttagctgcaaattagaatcacctgaggagcttttaaaacataaactgccctgtcccagtccaagaacgattgaatcaaaaacctgtagggagatagggaccaggcatcttggttttaaaaacttcccagatgattctaacaggtaaccagagttgcaaaccagtggcttaatccactgggacccccatacagccatcattttttattaaaacacacacatgcaaaagtctagagaatctgtaagaacagcctaagagatgattgccaatatttctgtagcacttcagttttaaaagcactttcataaaaattatttcatcaggttgggctcaatggctcacacctgtaatcccagtacttttggaggccacatgggaggattgcttgaggccaggagtttgagaccagcctggacaacatagtgagacaccacccacccaccacctccattgcccatgtctacaaaaaaataaaaaataaaataaaaattagctgggcatggtggtgcacgcctgagtcccagctactgaggaggctgaagcaggaggatcacttgagccaaggagtttaaggctgcagtgagccatgatcaagccactgcactccagcatgggtgacagagtgataccccatctatcaaacaaacatgcattatttcatcaaatctgcgcaacctctgacaaacacaggaatatcccaattcaaagatgaggtgactaaggcctgaaaggttaagtggctttgcccagggtcacagaactaaaaagtgtcagaccctgagcctgaatcaggacagctaacacaatgttttttctttctcaccatggcgccagcccattctgcctccccaactcctgggcacagtactaggcccaggccaggcactgagaaaacacctcttgaactgcatggaaaattcattcacccaaagacacgaggagcagggcagtattggtaaagcccttaggctctgaagtctgacagagaaggttcaaatcccagctcctcagagtgaccatgggagagttactaaacatctgattccttgtctgcaaggtggtttcatgcagaatctagctcagggattgtgagagtgaaatgagatcgtgcagctaagtgttagcaatgcttaatactgcctacgaaagaaaatatctttacgcactgagagccatagctctggagtaacatggtccctgaatccccacttaggagaaacaggtgacctggacaaggaactcaatctcactgaccctcattaagtaaatttaattttttttttttttttagaggtagggtctcactctgttacccaggttggcatgcagtggcacaatcatagctcactacagcctcggcctcctgcactcaagtgatcctcccacctcagcctcctgagtagctaggattacgggcacgcaccatgccgggctgctttcgttttgttgtagaaatggtgatatggtttggatttgtgtccccgcccacatctcatgttcaactgtagtccccggtgttggaggaggggcctggggggaggtgactggatcacaagggcagatttcccccttcctgttctcgtgatagcgagtgagttcttatgagatctggttgtttaaacgtgtgtagcacctccccctactctctcttcctcccgctccaaccatgtaagacatacctccttcctcttcaccttctgccatgattgtaagtttcctgaggcctccccagccatgcttcctgtacagcctgcagaaccatgagccaattaaacctcttttcttataaatgacccagtttcaggtatttctttatagcagtgcaagaacggactaatatagacagcatctcactgtgttgctcaggctggccttgaattcctggcatcaacggatcctcccaccttggcttcccaaagtgctggaattacaggtgtaagccactgtacccagccagaattaaatgaattaatatgcccaacagtgatagttatataagtgatagccattggctggcccatagaaagttctcaactaatgtcatatcctttttttttgagacagagtctcactctgtcacccaggctggagtacagtgctgccatctcagctcactgcaacctccgcctcccgggttcaagagattctcctgcctgagcctcctgagtagctgggactacaggcgcccgccactaggcccagctaatttttgtatttgtatttattttatttatttatttatttaattattttttgagacggagtctctgtcactcaggctggagtgcagtggcgcgatctcagctcactgcaacctccacttcctgggtacaagcgattctcctgcctcagcctctcaagtagctggcattacaggcatgtgccaccacgcctggctaatttttgtatttttaatagagacagggtttcaccatgttggccaggctggtctcgaactccctacctcaggatccacccacctcagcctcccaaagtgctgggattacaggcatgagccactgctcccagccagtttttgtatttttagtagagacaaagttttaccatgttggccaggctggtctcaaactcctgaccttaagtgatccaccccgccttggcctcccaaagtgctgggattacaggcatgagccagcatgcccgtcatatccttatagttacactgaaacccggtgacccgagtcaccctgcaggcagatgggcaggatgggtggttgggaagcatggcgaaagggcaatcacctggctggagtttcccgtcgttggctgcagcccccttcctgatgaggtgggtgatctggaggtagggtccatgctggatgatgatgaggcctaatcccaggctacccacagtgagtttggtctgctgtgttttgctcaagttgtgtacagatgttttgaccttgttgctgactcctctttctaaccaaaagaggggaacttatttcagtccttcaccaagacagaagcatggccatacctactggggttctgaagccagatccctgggacagttatttaatccctgttcctcagattccttgtcagtaaaatgaggataaaaatgttcaccttggagagctcttctgaaaattaaatgggtgcattaaagggcttttgcagagtctggcatattgtgagtgcttaatcaatattagttagtattatctgttcacttaacaaatatttattgatacagtgtgctaggccctgggtttaccatggtgagcaaaacagatgtgttgggttttttggttttaacagacaatgtctcactctgttgcccaggctggagtgcagcagcattatcagggctcactgcagcctcgatctcctgggctcaagggctcctcccacctcagcctcctaagtagctgggactactggcatgtgctactatacacggctaatttttattgtttttgtagagacagggtctcactatattggccaggctagtcttgaactcctggactcaagcaatcctcccacctcagcctcccaaagtgctggcattacaggtgtgagccaccgtgcctggcccacatgtgtttcttgtcctcatgaattttacagcctagtggaggggacagatatcaatcagtcatgtaaatatatgttggataacaaactgtaactcatgctatgaaagaaaaggacggagggctctgagaatgagtaacagagggccaaagtctcatctggggatggcgggtcaagcttccagcagggctaaaatttgaattaaggccaaaaggaccaataggaaatatttaggcaaagaaaggtggatccggagcaaattgtgttaaggtctgagaaaggaaggaacagtccctgtcagaggagggggaggcaggaggagcgaggaccaaccagacagaggctgcttctcagacttccttagtgaaaaggctccgaagtgagtaaagctggacatggttagatgaaatgaaatgacatgaaaatgacagggtcctggcacatgtcatggcagtgacagcggaaatgagcagtggatggatccaaaaagcacatgggggaaaatccgaaggccttggagacaaggggtagtgggagaggttgaaatatgttttctacagaaccaaatctcacaagaaaaatttcagggactaaaaggacattcaaaacaacaagttaatttcccaagaggaagttgctaggaaactccttttcggtacacaggaagctcctggggagatctgttttcagcacacttttccagcatttcacacacaactcctttccataaggacaggtgacacacaagcttgccaagtccatgtgactgtggtgttttcagggccactgctgagggagaggctcccccagctccctacctctggctgtggggagctggaggggttcatggccctttcctctaaagcaaatgtccttgcccatctccaacctcaccttcccccaaaccacagatgctctctgtttgggaaaataaaatagcataatataaacaagataccatcttcagagacctttcagggttctgggagcaactgggggcaggatacgccctgcctgagcctctggttcctgagcaaacagagaagtcacatcttgggcaaggtccagtggttcctatctcagtttgtaaattcaatatgcttataaggtaagctaccaggagcccacttttaaaagtcagcagggttaagtaaaagaagccagactcaaaaggctccttacagaagaaggacatgtctcaggagtttgatccagacctctataagcaaatgcagaagttcgggaaggcaagaaacacaagtacatcttgaaaaaaaaacaaaaaaaactttgtgcaaggcacggtagctcacgcctgtaatcccagcactttaggaggccaaggcgggtagatcacgagatcaggagttcgagaccagcctggccaacatggcgaaacctgtctctaagttacaaaaaattagctgggcatggtggcgcgggcctgtaatcccagctacttgggaggctgaggcacgagaatcgcttgaacccaggaggcagaggttgcagtgagctgagatggcgccattgtactccagcctgggtgacagggcgagactctgtctcaaaaacaaaaaaaaattatctgggcatgttggtgcatgcctgtaatcccagctacaagcctgggtgacagagcaagactccatctcaaaaaaaaaaaaaaaaaaaaaaaaagagagagaaaaaaaccttgacaaagtgaagttggatgtagattttcttggagcaagtaaatacatgcaatctcctgtctcaaatgctagcaacataccagaccactctgcttcattttggagagaagacttctcacactatggcagccatccatgagagcttcacaggttatcagccatatgaagtcactactttaaagcacttacaaaaccctctgaaaaaactagttgagaaagaagaaaagaagctcacccagcaggaaagcacagatgtaacagtgcaggagctgagtcaattaatttcattagaggatgaaaaccacgacaaggaaaacactgaagatggaaaaggtattttatgtgttttaggcaaaggctcttcacacagtgcatgctcaggatgaactattagacatgaaacctgaggaaagtgctcgctagggcccagtggcagggaccctggaacccgaaggtactgacaaagatgatcctactgctgttgaaagtgagatcttcaatgcttcctccctggaaaagggtgagctcagaaaagagtgagctgctgtgtttggggacaaccaggtggaggaggcagcactatggtcctcggagagccagaccccaagcaccagactaaaatatgaaagacttacaggttttgctacaaggctagtcagacagcaatgtcaaccttcccaaggacaagcagtccaaatgacaacagccctgcagtgaaaaagcctaaggctgtctggcacctgcctgcctagttcagcctctttgccaacctcaagtcttatcaaatcctgatgctgtgcggaaaaaagccataaagaacaagaattgctcagtgcaggagtctgcatccttcagtaagcccacctgggggctagcagaagtataaagtgattagagcctgggcaacatagtgacacctcatctcttctatttaggctgggcatggtggctcacacctgtaatcccagcactttgggaggccgagggtgggcggatcacttggggtcaggagttcgagaccagcctggccagcatggtgaaacaccgttgctactgaaaacacaaaaatcagccaggcgtggtggttcacgcctgtaatccaagctactctggaggctgaggggcaagaatcgcttgaacccgcctggaaggcgggggttgcagtaagccaagatcatgccgctgcactctagcctgggtcacagagcaagactctgtctcaaaaaaaaaaaaaaaattagctgaatgtggtggtgcatgcctacagtcccagctatgggaggctgatgcaggaggattgcttgagcccaagaattggaggctgcagtgagccaggagcataccactgcactccagcctgagcgacagaacaagactctgtctctaaaaataaaatacagtgacccatatgctattttaagatttatgtgcccttttaataaaaatgaaagggccaaagtccctatttacattggtataattttttaaaggctccttactatgtgatttcatttttatgatgttctccatggaaaaggcaaaaaaaaaaaaacgctgtaaaaaacagatgggggtgtgaggagctgcagtggggtggggtttggctgcaactgggcattgcaaagtaattttagggagtggtggaactgttccctatcttgatggagggggtggttcaacgtgggtatagcttgtcaaaacggtagctgtacttttaaaaggggggatcttactgcatggaaattataccttgataaaaataacgatggccaaggcgggcggatcacttgaggtcaggagtttgagaccagcctggccaacatggtgaaatcccatctctactaaaaataaaaaattagctgggcatggtggcaggcacctgtaatcccagctactcgggaggctaaggcagaggaatcacttgagcctgggaggcagaggttgcagtgagctgagatcgcgccactgcactccagcctgggggacaaagcaagactccttctcaaatgatgatgatgatgatgatgatgatgatgatgatgatgatgatgatgataatgatgatgatgataacaacaacgatggagagaggttatctcccaggccaagagtgcaccgttgccattttacagaggaggaacattgacgaaggcttggtccccagggcttcttcacccgcttccttctccccagttaccttttttgtttttgtgggaggccttctgcatggtcccgggaggtcaggcagcccgggagggcctcccggagcagaggctggagtcagtcccaatgccaacagtttcgaaccttgcccgcgggcactgccctcgggatggccgccagggggcgctgcgccgccactgcccagaaattgggcggcagtgaggtcgccgcaaggcttcccgtggaccctgcaaaacgtggcgtgggcattgcacaccattgtactgtatggaaacttctgcagaggttagcaccgtgcctgacccacggtggtttcttcattccttcttttctttttctttttttaagagacgggcagggggtgggggtctcactatgttgctcaggctcaacacaactgttgcactatgggctcaagcgatctgcccgcctcagcctcccaaagtgctgggattacaggcatgagccaccgcgcttggcttcttcattcattcttggtgaacctaagaaatagggagggggagaaggcacagaggagggtgtctcaaagatgtgaggtggtctgcagaggaagatcacagccagaagatcacaggagatcacagaatacctagaagatcagagaatcccccgctgcacttctaataatggtattttaaaaaaattgttacatcagtagctccaatgctttggaactgcactttttttcatgaatgttttgaataagaaaaggccccagggtggcctaaaaaaaaatgagtcactattaggagaggcactattaatgcttccttcttttttccaagataattcttcctcccacacacattcactcatacaacaagtatttacagggagctgttctgtcatttactgatactggggacacaacagtaagcaagacaaacacagaaacacaggctctatcctcttgaaacctgtacttaaaaaacagatgaagtggacaattttaggaaaatataaattattaaaaataaattctaggccaggtgtggtgtctaacacctgtaatcctaggtactcaggagactgaggcaggaggactgcttgagcccaggagtttgagatcagcctgggcaacatagtgagaccctttctctataaaaaaaatttaaaaattagctgggcatggtggtgcacatctgtagtcctagctactcaggaggctgagatgggaggatcacttgagcccaggattcaaggctgcagtgagctatgattgagtcaccaccttccagcctgggtgatggagcaagatcctgtctcaaaaaataaaaatgaataaatgagttagtaaattctagaagaaagagaaaacctaatgaggtaggccctggtgttatccccggtctgatgaaactgagaggctaagcaccttgccccatcccttcaacaaacagtcattaaccacctattaggtgtcaggcactgtgcaaagatttccatggtagatctggttatgtccaagcttattctgttgtttctgtggctctacacagacaataagccagggcagattcctctttaggttccttttttttttttttttttttgagatggggtctcattctgtcacccaggctggagtgcagtgacaaaatctcagctcactgcaacctccgccttccaggcccaagcgatccttccacctcagccaccagagtagctgggaccacaagcctgtgtcaccacgcccagctaatttttgtatttttagtagagacagggttttgccatgttggccagactggtctccaactcctgagctcagggtgatccacccgccttggcctcccaaagtgctgggattacaggcgtgagcgccaggacagatttctcattagataaaacctgtgtcgtagagaccagtacaaagggctattctccacctcaagtctcctgtgggtgacttcttgtgacaggtcacctttcctcttccaaacagtctggcaggggtctacatagataccaacttaattctatcataaaatacatctttttcctccatcttcctaccagcaggggaagggtaagagtttgtgggaatagagcccatcagcatatatggttctgtgatggagcatatcagtgcctggcctccccttagtcttccctccaccccaggctaaaaagtgtctttaaagcggaggtctctacactccaccaagccaagtaagccaaggtcacactgattggtggaactgcaggatacaaactgtcctgggtgctgtgctgcccagatcccccttcagggctgaaagacttacacttcccaccctcactactactactggctggaaagaacgccttgcccaagatctcaccttcctagattaactagcatctggtgactggtcaatgcagggccatcccaggttcagaactccccacgtggtccactgcagccttacttttccctctgccctgtcctgcttcattccttttttttttttttttttttcagagagagtctcactctgttgcctaggatggagtgcagtggagtgatctcggcttactgcaacctccactgcccaggttcaagcaattctcgtgcctcagcctcctgagtagctgggattacaggcacccaccaccatgcccagctaatttttgtatttttagtacagacaggggtttcaccatgttgaccaggctggtctcaaactcctgacctcaggtaatctgcccgcctcagcctcccaaagtgctgggattacaggcatgagccaccacgcccggaccctgctttattccttcttccaaagagtagatgctaggatggatcacctaatacccaggtaataatgaggtgcccatccctggtacaggaggagcatagctagcctctggcagagggaaactctaagatggctaattttttacaggcagtaaatgggatggtataccagggggagaaagcagacaagagtattcaattaccgggaaggaatcaggctgagacttcacatcagggcagggaggaacattgggcacccacgtgatctatttaggtgtctcttagtactcctttgccctatttggacagtaaatggacaaatgcagcaaccactgcctgagaagtgcacagcaactaggtgctcaggctctctaaggatggaggtctagaccaccccatcacgcaggccacctagatcatctgaggtgctggcagaagggaagaggtttctaggatggatagaagaggggactgaagggtatgttcgttatgcctctagatgagctgtagcggcggcaggagctgtagttcccactaaccctcctctatatgtttcccacaggaaaagattccccagggtcctgaaagtgctgctctccaaacttaagtagcaaatgagaggcacagcaccatgtgggcactattgcaaatgctgcactacactgcctcggtcaggactgaaggactattccccgcctaccgggtgggtggtaggttgacagatctcagctgtcagccctcttgaggaattgtctttgtctaaagagagctgccctccaagctccatggcaggtcagtgcagggatgaaaagacttggcccatttactccaactcaggccaactcagcagctatcctagtttcagaactcccctgggggtctgccaaagcctcccatgactgcagcacagactgacttctccctcttcccacccctgcttccctttccccataggacttgattctcaaaggctctctaataaactttctgcactaatcaataatcgcatttctgagtcagctcaaagggaaccaatccatgaaacaaactgagatttgagcccgggcgcaagctgctaactctggatttagtttcttgtgtcttctctaaccccagaaaccccaggtacatgtgtggtgcgtccaccatgctcttggcccacgaaacctaacccctagggagacagtgtgtttattgtcaggctgaagatactccttaaagagaagagtgatcacacagtcccttccacagctttgcccgtggtcccatctggattcagcctcttctggccaaggcctgccatccatcacaatagagcatgccatgttcatggccctttaacagctgcagaatggctgtttatgacttcaggctgcacagcatatctccctcctggaagccttctatgttcttctgggtccccaaggctttctgccataaggagtcttgtggctcatttctgaaaagtcccagctgctctgcttaggggtgggtgagaggatgggacgcttctgtcaccgaggccaggagtcttgttaggccagatgggggtaaaaggcccagagaggtgacatggctttcccaaggtcaagtcaggagcagggcaggaactagaacatagttctgtattctctctgcttcactccatcacctctcccaaacccttagggtttgcctctgctaaaatctagactgagatacagagagaaggggactgatctgtcctgcagacctcagagactggggactctgaaacaccagccaggcacagtggtgtgggcctgtagtcccagctacttgggaggctgaggtgggaggatcacttaaggccagaagttgaaatccagcgtggacaacatagtgagaccctatctctgacaaaaaaaaaaaaaaaaggaaagaaagaaaagaaaagagctatagggataaaaagagggattaatgggaaatctgtaaacagtttggcccctgccaaccccacctcccattctggatggtaggaaggtttgggataggtgactattctctgtactgatgtgcagccattagtatgataaaaatgttttaaattcttttaactcaatactggttgttcttgtgctttaatcttagacccagaaccatttgtaaagggtaaaaggaagaactgtattatttatttattttatttattagagacaggggtctcactgtgttgtccaggctggtcttgaactgctggactcaagtgatcctcccacctcagcttctggagtagctgggattataggtgcaaaccaccacgcttggctacttgtatttattgtaaacacaagaacccaatcatcatcattctattcagctggagttagaatatgtgcaaactgttcaaacattcagccctaggattcttctaagctggccagtagagaacatcagtggatattatctgggaatttagtcctgtatagttacagtttcttctatcactgggcaatagaaaaccccaacaagaagccaaatatgactcaattaaatttctccagtacttatttaaaaaaagaagaaaagaaaaaagaaactgaagactattgcagtaatgtgatatgcattatatctggatccttggagtatatgaattatcttgtgtcaatttctgtggcagaggaaaaataaattgtataataacaaaaaaaaaaaacctttcccccaagagaccaatgtttggacagaaaagtcaatatagaccagcaatcaaacccttccttctcccagctatgtagtgacactgatactctgttgcacatttctgcaaggctgttggatttggtggaatttgaaacctcctgaattttgtggacatgtaagcattccaaaaatagagacagatgtcactcttctaggtccttctagagacgacctatgtggcatttaaggagaaaatgagtgtttcatctccatctgctgcacggagtaccattagggagagctggatcaaacgtcagggttagtggtgattcggcccatgagctgtggaagaaaagaaaacctccaccatagcatatgctgacaaattatgcaaatgccttattttcctgtttattcatccaacttaagacgctgcacacacaactcagtaaacgggatcataacacctggttgctcaggtcaaaaacttattcttgagttctctttcaactccttccccattatcagcaggtccttccctctatctacaaaacatccaaatctgtccattcctctccatcttcactactctcaccctagccaaagctacacttctctctcgtggactacttggcctcttaactggcgtccctgttgtcatctttgcctttcccccatacaagctacactatggatcttcacagattaagtaagatcatgggattctgcaaacaccctccattgccttctcattgcactcagaacaaaatccaaggcccccaaagccctacacctagcctctgcctacctcttgtcatactactctcctgccacacaggccattttgcaattccttggacacgctgatctctttctgcccccctcccctaatgatctttgcattggctgttccctctgtctggtcttgcgccaggtcttcaaagtgcagatctttacgatcgtgatggtctcagcggaaatgcatccttccctatcgcaggtatcgctccgactcccatcacactgacctccattgaattcagggatctgcacctgaaattatctttattttacagataggttcttaatgtgtttctgtctcttcccaccagaacgtgagctccccaagagcgggcgccttgcctctgtccactccagcacctctgcacctacaacgtctgacgaagaggggttgtcgaaagctatttgctaaatggggcaatcctgggagctgacggccgcggaacgggcaatgagaatacaaggtgacagggaccgcgcggggcccggagtcgctcggcgggagtcggggcccgcctcctgctggaagacgggcagctccccactctcattccagttttgcttctgaggggctcaggaggggccgcagcctgtgcccagtcatcaacatcaacaatcttattagtgggcagaaagccaagaggtggcgtggcctgccagaagagaccgggacccgggcagggaccggagccgggccggtcgggtccgggtccagaacgtagaggcgggcggtgcggggaggggcccagggcggccggccgagccgggaggacggagctggggcgcggcggctggggagccgggaccggcctcgccaacgccgcggcttcgcttccgggtgaggggcgggcgggccgagcagttccggggcgggcggcggttccgtctgtgcgggccgcgccgcggctgctggtcccgggcgcgcggagggcgcgagcggcgcgcgggggccgagggggcgcgaggcagcggcgcggggactccgggccccggcggcggcccatggggcgggaggcgtgaggccgctgcctgtccggggctcggggggtggggggagcggggcggggagatggataaactgaccatcatctcaggatgtctctttctggccgccgatatcttcgccatcgccagcatcgccaacccggactggatcaacaccggggagtctgcgggtgagccgctggcgcgccgggccgggcgggggattggctgagggcgacgcgagagaggggagacccggactgaggagaggacggggtggagggtcccggccggaggctagcctgaggagaccgggggcggaggggagacccgggccgcggaggaaagggatggaggagaggaagccgccgggcgccagcgggacccccgggctgaggggagaggcgccccaggccgggtgaaaagtggccgaggagacctgggctgggctggcaagtcccggaccggggaggaggggagcagccctccgatgtgagggatcgcagaggaatgagcttcgttctggattaaaaaaaaaaaaaaaaaagtcaaggtgggagacgggaggaaactgaggctcctgcaagggaattagaaaccaggcggagaggctagggctgagagtgaggcagcctgcggggcagtgcgggagccactagagagctggtgggcgaggggaggccgagagggatcaggtccgaccccagaccctccaccaccagaggaagctgcggccgggggcgagcccgggctgcgggcgctgaccccaccaggcagggtgaatggtgggtgctgggagagctggtggggttggtgggagtggggggcgccggattggagcccctctgcaccgccgcccccgcccatcccctgcccgcttggcaatgtttgagaagcttgtggcttcggattttccctttgaagtgtgtatgtggttataattctgctttattttaggcccgggagctataatactactaataataaacctcattttatggagcgtctttcattccagcgcatcacaaaaacgctggagagctcttaatagtagttacaaaattaaataacacattacagttgcaggcagcccggcagcgggagcagtgcttgctgtaccaccacggagctgtgggcgggagaggcaaggtggtgccctcgggaaagaggcgggcatctttctgaagggtaccccaggtgaatgcgcttccaagatttttctcagcttgggccacttctttccctgttacctcttctccctcccctcttcccccgcctctctttctccctctctcccagacctgtgagaccaaaccttaattaatgtaaacagctgtcaggagagctgctccgatttaaggaatggtcttgttttttaactgcttgttcagtgcaggtgaaggaacttttggagggttgggaatgtcaagctccctccatggataatttcttataaaaatgcggccgggcgcggtggctcacgcctgtaatcccagcactttgggaggccgaggcgggcggatcaggaggtcaggatttcgaaactagcctgaccaacatggcgaaaccccgtctctactaaaaatacaaaaaaaaaaaaaaaaaaaaaaaaaaaaaaaaagagaattagccgggcatggtggcgtgcacctgtaatcccagctactcaggaggtgaggcaggagaatcgcttgaacccgggaggcagaggttgcagtgagctgagattgcgctactgcactccagcctgggcgacagagcgagactctgtctcaaaaaaaagaaaaagaaaagcatcactgtgctgtcaaaacttaatttttaagtattacttatggttctgtatttatcctgcaatatttttagctcttagaaaaaaagtggtagctgggacatttgttgcttcctcctccctcccttctctcccccaatctagacctagtaacacaaaatcatgctgtcatattcactggttattaaaataacactctaaaaattctgctacttttcttgcccatagagttttagcagaactcttaattgtaaaagatatgaagaatcaggatggtttcgaatttggtggtactatgggctttgtttatgaaaatattgttgctgcccgacaacttaacacggttacatgtatgacatccagttcgtgacctgttgatgtttttatcctacttacatgtgtattgactccttttatgagactttcaggcttcacgtacttaggggaaaaggggtttcggtgctgtagcagaaggaatctttttacaaagaagttttagatagaatcccaatagataaaatagactaaatgaccatgcaaaagatatagttgaaagagaagaattgttacatataaaagagaagaaagataagtgatagcataacgttcctaagatggaaaagggcatagccgggcgtggtggctcatgcctgtaatcccagcactttgggaggccaaggcggacggatcacctgaggacaggagtttgagaccatcctggccaacatgatgaaaccctgtctctactaaaaatacaaagaagttagccgggcgcggtggtgcatgcctgtcatcccagctactcgggaggctgaggcaagagaattgcttgaacttgggaggcggaggttgcagtgagccaagatcacgctactgcactctggcctgggcgacagaatggtactccgtcttaaaaagaaaacagaaaaaaaaaaaaaaagggcaagctcctcttgtattcagaagaaagcaaggatagaatgagtataactctttaaaatttggaggcaaaattggctgtgagttgccatggagataggagcaatggatgtccaaggtctgaggaaatagaaactgttcgaaataattgcagagaaagcttgccaacggtgataagtaggtttgtctagcagcactgatgcgtcgtggaagttgatggtcatgaacatacagtgtgataacctatctgccctcttgaccttttctagtagtgctatgtcattttggtactaaggtaggtgaattttccaagtgttcttggaaataaggaaacatcaagaataatgtaaaagcctcatatacaataatgaataataaagaataatgtgaaggcttcattcaaggttggggtttgccagatacattgcaacaaaatgacagagcagccaaggtatttaggatagtggccaaagtattgtaatgatggcttatggagtgtcagctggataaagagtgaaaatgaataaaaactaatggattgttcagtcgaatagcagatggtacaatggtacatggccagtagaataggggacccaataaaattgaagaccagtcagagtgggagtgatcaatccagcaaagtggaatggcaggggatcgtaggcacaaggtccagagtgtaacagtgacaatgtgtggctgatgtgggatcgaggaagtgattgttttttttctaaaagttttccttgccatctcaggataccactccgttaaatattatggctagaaagaggaataagagatactaggaacataggaaatttttaaaattcttatctagcatgtatttcttaccttacatatgtcaggcagtaaaccccccaaaacataaaacgaatgggacagtatgttccttggtttaccgttgtgcttgagcttgtatgctgtacagtctcacctgagcaggcagatgtagtcctgagttaaaaaaaaaaaaaaaaaaagtgcagagttacaccttccaaatcaatgaaacatttacaagaagttcaagtaagatctcagtggtgacaggtctagcttatttcaagagctgcacaaaagccacttaacctggcaacaaaaagttaatgtgttggttccctttggtgtattatattcagtctattaaagttttgattgtgatgttttcattgcagtttttataccggataaaatgtattttagaagtagaacttttggagctgaaatagtctgcagaatgtagcttgaaaaccacggcagtgaactactaagggaaagtttcagaattcaagtctagacttcatcacttcgtagctctgtagctttagggcaggttctttagcctctctttgtctccgtttcctcctgtgtaaagtagggataataaaagtatccatctcactgggatattttgataattaactgagttaacccatgtcaaacatttagaacagtacctgacacacagtaaatgctcaataaaaattacatattgttatattgctgttctagtttataagaacaggtgtcagaatccagttttgaaatgaaagcccagaactgtgagaaatgatgtttttctctattagatgttctaggaaataaggaaacatcaagaataatacagccatgcttagaacaagttaaatatatgtccctcttggctttggactttctctgtcacttccgtgctgttcttcctcttccagtctctccatactctaatctctgttctcagcttctacttgaactaccatagaaggaatagaaaaaaaaaaaaaaaaaagagtaacttcctgaagtccctattgataaactgttactataagattatggaccatactttggacagcagagtttttcatgtttttattgtcttggtctagatacagagaaagtacatcccttttattttcacctgtgtgattaacatttcatctacttcttgtaatggcttgtggattatgcacaaacttttgaagatctgaaacatattgtatgtatgggggaaggcactctaatgaagactgtttgtgttagtgtaaccagaaatattaaatgtagatgaatacagtggcaaaattacataattctgctatgctaaggtcaaatttctgctggttactggaactcaacaccaataggaatatctttgattttatataatgcttcatagtttttgaagcactttgacatccattacttgatctgattccttaggatgtttatatttggccaatgtaaaatagtcattttcacattttcccccacatggtagtgctttgcatgtgagatttgagtttcagtgctgcaaagattccattgaagaaaattcttcactgaagtattacctatatgttatttatgcacaccttttacttatcttaaatgaaattaaaattcttcagtggctggaggttttcccagattacagaagagggaaagaaggagacttgggggtctttgctttgtacaagcttcttaatttcactgtcactctcttctcacccctgaagagactttttgtcagggggaaaaattagtgttagttaattttaacaagataaacagttaagtaaagctgcgtctctgataaatataaatggtctgcagatccctttagtgaggaaggcattatcccctcacagcaaggatttcagtgaccgtaatcctaatcatcctagatagatttgccttatgttctttatgaagatttccagatgttccccaaaagtctctttcaagtagctgaaagaacttctcccttatgtctcgtcaaaatttccctaaagtggttatcatattcatgttatagtttgtcataacgaagttaaggttagtgtattcatttctgaagatattttcattcttgttgtttttaaaattgtctagatgggatgttactgtttggggggggggaatctcaaaaactgacatgtttttccctgcttgtattctgaactagttgaggggcaaaaaagaaataaggtatttaggggctaaaatattattttattactaagaaagaggatattggagaatgtcacttacatttgggggcacgtgacgtcctactcctggaccttaaaattgagcagacttaacaatccagtcccagacagaactgggggaactgcccctataacacttccagcatgacagaggagagatgagtgcttccaaagacaaaatgttggatcacatatgcccattttctcctaaactaccagtcagatgaagtcagtccttgtgacctgacaaggattgagtgaggagacacaaatgagctaaaagtattatgccaacaggattctgtcctctcccccggtctccattgctcatggataataaaatcgggaataaggagaaagccttatgtgtttaaaacccactatatgtctagcattttgtgaggaagagttttcattttcttcaggtctaaagattggcaggtgttcagggaagtgaaagccttggtgaggggtatcatttcctattctgctacctcctacctacttcataggaaaatctggtaaacctcagataagggactgtggtgcttgacatctatctcataagggttcaagatctacaggtagatcccagcctatgcactggggatcctcagtttaaaacactaaaattacaagttgctcaagcagacctgtttattaagtaatagaaaatgattaaatcattagtcctttccctggaactgtaacaacttcaaagatcacaaaggtactttgacatgaaagaactctgtaacatcagttgttaaacaaacctatctcaaactttattttattaatcactttggacatgatttatagaggacaggatttggttacctaaaagggcaaacattttgagattgtgttgtccttgaatttaaaaagcattaataatatttcttcattggccttttgagcctatttccagtaaattttttttaaagagctttattgagatgtaattcacataatactaaaattcatccatttaaagtatacaaataaagtatttaaagtatacaaatcagtggcttttagtatcttcataaagttgtgtgctaccatcaccatagtccatttcagaacattttcattactccaagaccaggctaagaggtgcctcttagcctcctaggcaacccctaatatgctttctgtctgttgatttgcctattctggacatttccaatcatagaatctatgtgatcctttgtgacaggcttcttaaacttagcataatgttctcaaagttcatacatgttatgacttttttttttctttaagagacaggctcttgctgtgtttcccaggctcaaactcctgggatcaagcaatcctccagcctcagcctcccaagtagctgggactatagatgcacgctgccacacctagctatgtatttcttttttattgccaagtattccattatatggatagaccacatttatttagccattcatcagttggtggacatttggaccactcagttttttacttccaagcataaaagtctatgaagataaagtgattaaagatgttttttaaatgtgattttttaaaaagtgacattatcagtataatctatttcagcatatcaagtaataattatcaataaaaattcaaaaaccggtctttttacagtactcacaggacatgcttaaagcttgagatcatttatgatactgtgaattcccagagtggactagattttccaataggaaattagatctcctgaacaaagcattaatatttcctttacaaccttagttccaaacatcatctcttttatcattaccaacagagatggagccacttcagaattaagactataaataagcctaaatgtttttggagaaggggaatttaggatgaagaacatgaacagcaggcatgagtaaatggaaatcactaaaagaaggaaattcagaagaaaaaaaattagagtaaagactgctgatgcatttgttagattggccatacttattgagtccttccttatttggctgccagaacccctttcaaattttgcatagtaatagttacatatatcagttctccactgttctgcttagtgtgaccaaaaacatcattgtttaatccctttcctggtaaatactgagtttgtattggagttgcagtatagtaaaatggttctgtaggatttggagtcaggcatatctctatttgattcttggattccttttttattagctttatgatttggggcatgtaatttgatttttcagctataaaatggagacaatacatttacctcaaaggatagttgtgaggagataaaatgtggcatataagagattagcacattgtccgatacttagtaaatgctcaaatgttagtcatttattacataaaagctcaaaacatctggatttttagtgtttcccttttgtactgtctgtcttatttatttacttatacctgccttgttccagaaagagatttaaggcaacataatgtgtctgtatttgaatgttcgtgaacccagctgggtccaatctgggaagagagactgcatagtcagttgttgtggtaatacacacttatgggacacatgtaactaccaaaaccaaggagtacttgggtttttatgtttctggaacagattgaagaggttttctaagtgaaagacagcctagcatagtggaaatggcacacgggctttggggcaaaccaacatgtagccaagtccctgtcctactatttacgagccgtgtaattgatcttagacaagttgcagttgagggtttttattaatgaaaattatatcattcagacctgattaatacctctttcagcacttccaatagttatgcaggtttagactccaactttgttctcctgtgggttaaagaatattaaccacagtgtattgttaagatcatttagttcagaggttagttttaaaggaatttaagagctggtagtacagttggagtatcaagtcaatttttctcacctcaaagtgtgaaaataagtttgaaatatatgagatagttggttctttatagaaacctggcaagcgatatagctgaagatttagtttatggaataaatttttttctagttactagcttctgtaatgcaactgtgagttcattttttccataacccatttcaatgcatacttaggtggtgggccatattgcataatcttataggggaaatttagacatgtaatgaagtgttcctgtttatgaaattgtcaccattgaattataaataagaacttgttcgtgcaacctgaatgcataattatttacatagtgaccgtgtttgatatgcttctctaagagacccaggaaattaggttgtacggtgacagcagtgacaagtatataggtataaatttcatatttacagctttacctttgtgatggtttatataacatgacattcatgtctttttggttgtcagaatgttgtattttcaagttctgaagctacacctttttttccaagtactttctagaattccccgcccaactaagcagctagcagctttataattagaaaacctgatccgattgataacaacagattgaaagtagcagttatttcatcctttatcaactacaaactgatgaaaaagtaatgttgggaaagctgttgtagaaatcctaaagaggcttagataagagccatgaggaaacctgaagatctttgaatatcaggatacctaaaaataggtacctggattaaaaccatttttcaataatatacccttactgtgtatttcacctaaatttactgtgtttgtaaactttactgtgcattctcttgttaactgcaaattacacggaggagaattcttgccaaatatgcaatgagcaagtagaatgtgacgttcctttggggtttattgctttagagttgacaaaaaaaaagagcatttgggtttgggtgttgctatcaatggtacttacatgtatttgtgaatatgtaccaactaacatgtatagtttgcttaagggaagtttcagtgtgtgactccagttcacttttgaagcaaactgacaaatctttgaatcactgcttttttttttaattagcaaaaggctgcactttgtgtgtctcattatactagctttgctataaataaaatatcacatttggcattttgacacttgccgttgtatatattgagcaaaaaggcagctgttgacttttaatatagatctgttcaactagggaccatattctactatagttagagattaaacaggagtagaaaaaaatgcagttgggtgggtcaagtaagaaaaaggaagaacaaaatttcattattgcaatatattcacagtaagttgtttacctggaacatggttgggtccaatttcagccataataatagaagttcttttcaaaaataggccatgttcagatcagttctgctgaccaggccactgacctccaaagacaaaaatctttaaggccacttagactgtcaaagagatatgaccatttgatttataaggtaccatcattttgataaaagaaatctttaatttactatgaatattttaaaaatcttcccatagatattccctatgcgattggacttcattccagaccatcttgcaacaaatgctattgacgtatttgtggtctgtaaggaatctgtactgaaataatcagagagattatgtttaagcaaatgaaaaaagtccttgaggtaccctataccctgggaagataaaattgtatcttgcatgtcttacatcttgtgagtatgtaccaacatatgcataggatcaggcaatcagagaggaggtggaatttgagcttaacagatgatacatttaataatgagtaataaggaagacttgggtggttcttgttcttgaaaagggaatggcatgagtaaaggtagagaggaggcagtgaaatttctattccagtccatttctctgtattgcaacttactttatctttctaaagaacaaatagaataataaatacttgtatagcatttactttgtgacagattcttttctagacactttacatgtgttaattgatccccacaatgcccctgtgtaagtgctgttatttagacagcctcatgaaaatacagagaagtcacttgcctaatgtcacacagtggatcctggctcttaactattgcatgtgcttgtaccagaaaccttcagtgacttcatcttccacaggacaaaagacactcaaggattttcacaatctggctccaacttataatactttctggccttagatcctgcttttttccccgcatgaatgtacattctagcccctctgtattactttctgtttcctgtgtgtaatctgtattctcatctgtaattctttggtcctctcactctctccagtccctgttttatcagtatcctacccatcttccgagcatatcagttgctatcttcataaaaccttttttgatcccttacctaaagtgattttccaaccccttggtaacactttgcacattttttatggtagcatatctgtgtcatggttatttgtgtggtacttgccctattttctagtataatttttttgtagtatagatttttttaaagttctttgagagcagggaatatgatttgttgatctttgtatcttaggcagcattcagtctaagcttgcacagggcaggaaagaggaaatgttatggttaacactaagattttgaacctgggctagggaataaaattgggaatttagagagtgaggtgattgtaaaaagtgaggagttgatttagacatgttctgtttgaggtgatagtaggatatgcaagaagaaagggactagagctcagaagacaggaatatttggcactcccagtcttatctcattttcacaagtatgatacttaaattgctacatatcaaattagctgcatatccatagaattcaggcttcttttttttaaaaaatgtatcagttggggccaggtgcggtggctcacgcctgtaatctcagcactttgggaggccgaggcgggcagatcagctgaggtcgggagttcaagaccagcctgaccaacatagagaaaccccatctctactaaaaatacaaaattagccaggcgtggtggcacatgcctgtaatcccagctactcaggaggctgaggcaggagaatcgcttgaacccaggaggcggaggttgcagtgagccaagatcgtgtcattgcactccagcctgggcaacaagagcgaaaactccatctccaaaaaaaaaaaaagtatcagttggtttttatttagaaaatgaagtccagctactatataatcattcctgactttaattttttttttttttttttttgagatggagttttgctcttgttgcccaggctggagtgcaatggcttgatctcggatcactgcaacctccgcctcccgggttcaagtgattctcctgcctcagcctctcaagtagctgggattacaggcatgcgccaccacgcccagctaatttttgtatttttagtagagacagggtttcttcatgttggtcaggctggtcttgaactcccgacctcgggtgatccacccgcatcggcctcccaaagtgctgggattacaggcgtgagccaccgcgcccagccctgactttaatattataagatgaaacttaatttgtaggttgttttgttgattctctgggtcaatacggaagttagatttctaggctagcccacaagtccatgttgtagttgaaatacttacttctgcaacaacaaaatagtagaaagcaatacagttgctttactatttgcattttcaaaagataaaaaggaacaagaaagtgcagcttatttttcttattcttgatcggtttgacttcaaagcttacagcattcctcctatgtgatatagttgttcactgagattcttcttatatatgtcaacagtgttttgggttttctggccctatcagaggaattacggagattgtatgtgtaagaggtttcctgaagtggaataacctgtggtagagttaactcagtagagctgaggaagatacgtatgagtgaatgcaagtgcatatgatatgtgtagtttgctgtggtgggggtgggtaggggatggtgaggaacttgtaatgggtaaataatctctcccatgaggaagcaagatgaaatggaagaggttggatccaatgttcctcatctgagcccacgggaagggccattggtctggtctagaatggttactgctcgttgaggggacctctatggttggatagagtaaggagaaaaacagtattttgtatgccagtttaagtatgataaggtgcagattaagtcttttatgttgaaatctgggttctgattctggctttcccatggttgttttgtttgtgcttgaaaatttacctaaattttgttattctgtattttcccccaactgaaaaatagttcctgtcccccttcatcttcatgaatatcctcttacttgaaaataaaagtgagtgtatatgatatgttaaattcttaggaaagtattttattcagaaagttaaaagagtatgggggctgggctcacacctgtaatcccaacactctgggaggccgagatgggcagatcgcttgagctcaaggagttcgagaccagcctgggcaacatgatgaaaccctgtgtctacaaaaaatacaaaaattaacccggcgtgatggcgtgttcctgtagtcccagctactcaggaggcgtaggtgggaggatctcatgagcctgggaggtggaggtggcagtgagccgagactggaccactgcactccagcctgggtgacagagtgagaccctgtctcaaaaaaaaaatatatatatataggggagaagtcagaactcagttcaaattctggttctgttgtttaccagctgaggggctttgagcatgtttcttggcctcggagctatagctttttcatgtataaatggggataatacttcttaccttgaagggtggttgtaagaattaaagttaatatatctgaaacatctaccacagtacaggcacacatggtaactgctgttattgtggttaagcaactaaatggattaatctcttatcacatttgatacatggaacataaacattgcagttgattgtttgcccactatacagttactgaaggcaatctgatgtttttaaagtaggatatatcattgttttatccttggctgcccgtatcactttttttttttttccattaaaaaaagtagtctcgctatgttgcccaggctggtttcaaactcctcctgaactcaagcagttctcccgccctgacctcccaaagtgctgggattacaggcatgagccactgcccaggccctgccggtatcactttcacgatgtacattctaaccatgcccctgatacctggattgctatcttcttccagctcagtgcactaagagtatcagacagcctatccaaatgtttatatgcaggtgctgtgctgcatatcaaaggtaatgtgtatttggggatttttcaagtgtgatgacagattgtactaagccactagcatccttcaaccttcctacactagccaacatttgctaactgggttatggatgtaatctgtagtcctagggtagatttccctgactggctaggtatgtaaaccataaccctaacctcattagttgaggttagtcactatcatggactgaatgcacccctccttccaaattcacatgttgaaatcctgacccccgatatggtagtattaggcagaggggatttggggaggtgattaaaaagaggtctagcccactttgtgctatatgaagatacagtgagaatttaccagtttgcaacctagaagaccctcaccagaaccggaccttgctggcaccctgatctcagatttccagcctccaaaaatgtaagaaatgaattttaattgcttttaagccacctggtcctttgttacagcagcccaaatggactaagacagtaaccaagtgtcagtcaagggttgtaaatgtaaaggatgattgataatcacaggtagcctacaagataatttatggtataatcttattcatcttcttatgatgaaacgtaaaatgtgagactctgtttttttattctgtagacaaaatactttgggtttaaaaattttttaaattgagtcacttaagaaaccatagcaaagaatcttactaagacaaatgtagacagtcatatatcagcctactaaatcaccttttagactcccactctggataagatttagtggattaggattagaagacaaacccttttatgttgatatgttgctaatataggactaatcctagaaacctcatactctttctgaggttcttaccattcagtaggtagctattatcgtgtaaccatttagaattgcaccattagttaagtaagatgttggctttaagtggaccaccctgtattgaagatttaattatcctttattgtgactatcttgacagttatcagggatgttggatacattatgggttttccctactgtgctatttcttttattttttgcctctgtaagttgctgggcactgctttttttctctttttattagcctagaattaactaaaagattgtatctcttatccatcacctcctactgtgctctgcccttcctctctaggagcctcttgtggcaaatctccaacttggccattcaagcagttcatacccagatgaaaaagttcaaggtacagatatcagccattctcagtggtcagtttccattgtctttaccaatagctctctgctgtgctcagctcctgtttctctgagcttggggttttactgagttttttttagaaaatccgtcaacttatctaatgaagaagactcttgtcttttgactgtattgatacaggctacagaggtacttactccttttctgtgaacctgttttctcttgtatagattcaagaaattcttcagtgattctgctttgttgatggtattcttgtcattttctcatgctgctatagaattttgtacaaattatatatatatatatatattttcttaagaaacttagtttatccaacaaaaggactataacactattttacattcttaattctgatataaagcacattttcaaattagttgccaacctttgttttaaaattatattgaaatcctggatctagatcttctagacagtttctttggtatattatattggtcatttcagtggggtttggagaagacaggagaataaattgactcactttacctcccagcaatgtttaatgaatgttgattgaatgagtgaaattagtggttaggtagagcagttgatttggcctaaataatatttacaaatatgtataggagatttagtctacagcagttgattatctttgaaaacttttttttttttttgagacggagtcttgttctgtcaccaggctggagagcagtggtatgatctcggctcactgccacctccacctccagggttcaagtgattctcctgcctcagcctcctgagtagctgggactatataggcttatgccaccacacccagctaattttcgtatttttagcagagacggggtttcaccatgttggccaggatggtctcgatctcttgaccttgtgatctgcccacctcagcctcccgaagtgctggaattacaggcatgagccactgcgcctggccgaaaacatttttaatagtgggaaagttatgatacaataattttcttaaggtcacacatttaagtaaccagaaaaggtttaagttttatggctcctatttatggcagggacatatgtgtaatcagttagaatgcaggagacattatattaaagtggctaacaggacagactgtagagcctaggttcaaattctacctgttctgtctggacatgacggttcatgtgcctgtaatctgagcactttgggaggctgagatgggaggatcgcctgagcccaggagtttgagaccaacctgggcaacatagcaagacttcatctctacaaacatttttttttttaattgctagtcatgatgatgtgtgcctgtagtcctagctactcgggaggctgaggcagaaggatcgcttgagcctaggagttcaaggctgcagtgagatatgattgtgccactgtactccagcctgggcaatggaacaagactctgtctaaaaaaaaaaaaaaaattctatctgttcagcttactagcagcatgattttgggcaacatacctcagaggtctgtttcatgtatataaaacacttacagtgcttggcacatagcactatgtaagtgtcaactaaagttaatcagactaacttttgaagatccttagctatagtcttttcgggagccataggcagttatcttaaaaattgatcataaatactttattgtaataaatattaagttgtagatataaatgttaccataccgattctactgtttacatataaattctagtccatggacaactggccacagtgtttacctcatatgaatagtaccactactgtaaagaagagtagtcttactgttgaaaaaagtaaatttcaatattgaatacaaattgaaatcagtgagcctaactgtacatcaaattaatcatgtaaccatcaaggaaaaaaggaattatcaagtaacttttcaacataaaactctgactgtgctctcttaatgatgggatataacctaaggacaaaaagaactgcaaagaaatactgatcttagtaggtaacaaaccccctacaacagctctgcaggggaaatgtccccattttgctgttgaagaagcatattcaaagaagggaatgatttacctggcattaaatgatgctggagtcataccacactgctgtttttatagtgtgctgtttctgatgagtcctgttttaaccatcctggtttgtttagtacctctctcttattaacaccctctgtaattattagaaccacattttcaagaacttagtaaccatttgaacccccttttttcaataatttcattccatgtaatcaggcctagttttttgaaatctgctttcctaaggggtatttgacctacccattctttacaaattctgagatgacctagatgacctaacagcttttttcctaattcctcctgcttcaccaataactagttcctggaatattagctagtgtccaagtcacaattatttatggtctgtatgataactaagtctggaagttggatatgagagaattgcattcttttttttttttttttttttggagacaggatctcactctgtcgcccaggctggagtgctgtggtgcgattttggctcactgcaacctccaccttccgggttgcagtgatcctcctgactcagcctcctgagtagctgggatgacaggcacgtgctaccaagcccagctaatttttgtatttttagtagagacagggttttaccatgttggtcaagttgatctcaaactcctgacctcaggtgatccgcccacctcggcctcccaaagagctgggattacaggcatgagccaccgcgcccagcctgagaattgcattcttaaagacattaatctgtttgtaatttaggatgtcttatagtgatttggtggtgagacatacgggaaggggtggtaaagagtgcaattgttggacctgtgctttttacgtgaaatagcggaaatgagtattactttacaaactggttttggaaatgattcattcattaaagaaagcaaataaaaatagcaataaaactaggacataataactggttgttaaatgaactctatgtcctttgaaaaggagatgattaaggaagaaaatatgtaaataacttgggtacacaagctgctatttgaaattctgctgagtaaaaatgataggaggagttaaactgttcaggaatttagctcttgcttaaagtattcgtgtagcaagtctctgttttttttaaattacagtgtttgaagatcctcttcttgaattaacagaatcaaagtgaaattccattttttaaatcactcctaaactgtctttagtgtgtggctttaaaatataattctatgtaatatactagagaaattctcaagaaaatctaggactaggatttcaatataattttaaaaggaagtaaggtgggcaatcagattaatttgaaaaagtgctttatatcactagtaagaatgcaaaactgtgttatagtgctttcattaggttaactgcgtttctaaacacctggagaaaattattttagtattttctgtccaaaatagcggtttgtggaaaatgcgccacttgtctggggaaatcagtgtttatgagacatctttgttaatgtttctaaagttttaactctctggacaaacattcaagaaaaatttaaccgttatacaaaaatattcctacatagtaaactttgagcacacctgtggaattagacttggttcatgttctaaccaactccttctagctggtaccttgtcatttagcctgttactgagtttccttattgaattgttttgagaattaacttgagcacacataaagcacttaatactacacccagcactaagaaagcactcaaaatatagtggcagctattattatttatccttcttcctctccgttttctcctccagatttatgagtgatagggacagaaaatttcttatcagagtgccctttattttaatctcaaggttttgaagtagaatttaggacaaaaatagatttttctgaaccaaaacactgaagattctgtttgggaagtgagaaagcaagctgctaaacacctactctacttgtgcagtgacaagaaaattgaatttctcattcgtttcctgcccctagcccttgccttcagtttctctgcctcagtatgaaagtatctgtattcctttggggacagttgcctcactgaagccacaaagagcagtctccaggagttgtgtggcaagctaactataaccttttggaagaacatctggatacagttttcatttttaaaatgtatcgttttttaggtcattagatttatatagttcaaatttattggtgtcagttctcttcctaggttgtaccatccattttgaaaagatgtatgtcttttatccagaagatgtaaagtatatagggtcataatcaataaaaatctctatcttcagttaaactactggagttttcccttcttcaagttttcagaatataatcattataccaaacacacgtgtgcgtatgcatatatatccatccatacaaatataactttcctttattatgattactcagttgcaagcagtgtagaagttataatatttgttttattataatcatttcagcaatatggatagggctactggaccctggaatttgaaaagagaggatcttttttatgttttttttttttaattttgataaaatatgcataacgaaatttaccatcttaaccatttttaagtgtacagttcagtggcattaagtttattcacattgttttaccaccgtcaccccgatccatctgtaaagctcttttcatcttgcaaaaccaaaactctacacccattaaacaacttaaaaagagaggatcttaacatcagaatcacataattactactctataaacatctgatgggtgtttacttctaaaacaactgctttcttttttaattgacctttcactatacttagcctcttctaggaattattatatgtaatctactcagtcatattttctttaatttttctctttctacaactttacttttccaaaggtgatgtaaattacatgttttatgttctcccatgtttatactctacttaaccttccctcactcccataggcttgatgagtgtatattgtcagagcattatttcctgtacccactgctatgtttgtttgtttgtttatttattttgagatggagttttgctcttgttgcccaggctggagtacaatggtgcagtcttggttcactgcaacctccacctcccaggttcaagcgattctcctgcctcagcctcctgagtagctgggattataggcacctgccaccatgcccggctaatttttgtgtttttagtagagacgggggttcaccatgttggccaggctggtctcgaactcctgacctcgttatctgcctgcctctgcctcccaaagtgctgagattacaggtgtgagccaccacgcctggctatgtttatatttttaaaagtcctaaaagtcagatggtttaatgtacatacattcttgacattttaaatacctccaattttgaaagcattctttctctgggctgttagatacatgtatgattcataaaatgaaatagggttgcctgtagttatttcttgagttgccatttagagtcttctggccttgtcatctgtctagggaagaaatccagcataccttactgtcatgtatgtcattgtagatcttatagcttcagaaaattctctttccttttcttcagaattcaccagttttaaagctttttcctctccttcaattttgtcaccaaaatgtggctttgcagtcacttgacctgtaactttacacacttaagtctgctagacagaaaaatgctgttgcattcttaaaagcttttaagcagttatttggacttttagtagaattaattaactaatttatttatttatttatttagagacagggtttctccctgttgcccagcctggagtacagtggtgcaatcatagctcaccacagccttgacgccctaggctcaagtgatcctcccatctcagcctctcccatagctgggactacaggcatggacactaccatgcccagctaattattttgctttttgtagaggtggggtttcaccatgttgtccaggctgctctcaaactcctgggctcaaacagtcttcctgccttgacctcccgaagtgctgcgattacaggcgtgagccatggcatctggccagaatttctgagttaccagattgctaaacaacttcacagaaaaattaataatagtctcaaaatattgttttcttctgactcctctcaccataaattcatgcttctccactctactctccccagcagattctggaagtttcctagcaaaattgcatattgaagcacattcaaacttaaggttgaagaaatctacacaaaggacatcattgtgttattttagactctaggtggagtctgtactatttgttctaccttcacccttatttagaattgataagaatgcactgagccttagtactctctggggtctgactctgcaggcagatagatattcactgggatccagaacctatcatacatcactgtagaaaaagattcaaatacagtcaacgtatttgaaaatcaaaaccgtattttccaaacagtcaagttaaaagtgtatgtctgcacaaagcctatccagttaagacagtgtgtgtcactatttttccttttgcaaacttccttagtgtctgaacattaagtgcatatttcttaggcaaattatgcatcagtacttttctcttcacaattaaatatttccagcagtttgggactcatttttaactattcctctccctgttttttgagacagagtctcaccctgttgcccaggctggattgaagtggcgcaatctcggctcactgcgacctctgcctcccaggttcaggtgattctcaacctcccaagtagctggtattacaggcatgctcaccacacctggctaattcttctatttttagtagagacggagttttgccatgtgggccaggctggtcttgaactccaggcttcaagtgatatgcccaccttggcctcccaaagtgctgggattacaggcatgagccactgcacccagtctttttttattattattattttaagcattcttctgagctgacaaatgattatcaaagtgattctgatttatgattagtttatcccattttttgaaaagtatgttttaccttctctaggccaacctgcaataaataagacccagttttagtgggagatacaattaaacagttgaccggaagtcagtaagaagagtgctaaaatagtagttaagtgcatattgcagttgaagcatattagatgtgcctctaactcaggcatggaaggttagaaacgactacatagaggaatgacatctaagccaagatgtaaagaacagataggatttggctagagaaggaagggccgtaagaatgttccaggtagaaggaagcctcagaggtttaaaagaatatattacatgtaggggtcctggaagctcagtgtaacaggaggagtttgagggaaggagaggcatcagatgactctggatggggaaacagggactaggtaatgaagagctataatgaaatataattccacttttctttttaaaacagatttattgaggtataattcacatcatacagtttacccctttaaagtgtacatttcattgtttctttagcatattcacagttatacaatcatcaccacagttgattttaaaacatttttgtcacctcaaaaagaaaacctgtaccttttagctagcacccctccaactaccctagtcctaagtaactactaatctactttctgtttcatacagtttacctatttggatatttcatataaaggaaatgataacgtggtcttttgtgactggcttctgtcacttagcataatgtcaaggttcatacatattgcaacatgtatcagtacttcatttttattaccaaatgatatttcattgtatagatataccacattttatttttccattcatcagtaagtagacatttgggtcctttctactttttgtgactattacaaataacgcctctgtgaaccatgtacaggtttttgcatggacatacattttcatttcccttgcatatatacttagcaatgaaattgctgagtcatacagtcattgtatctttaactttttgaggaactatcagactgttttccaaagtggttgtaccattttccatttctgttaccagtataggagggttccagtttctccacatcctcaccagtacttgttatttgtgtttttgattctagccatcctgttgggtatgaagtagtttctcttttggttttgatgcgcatttccctgattactaatgatgtagcgcatctttccatatgcttattggccatttctgtatcttctttggataaaagtctattctgatcctctacccttttcttttttttttttttttttggtgagagattctcactctgtcaccctggctagagtgcagtggagcaatctcggctcactgcaatctctgcctcccagcttcaagtgattcttgtgctttaagcctccggagtaggtgggattacaggtgcatgccaccatgtccaagctaatttttgtgtttttagtagagatggctttttgccatgttggccaggctggtctcgaactcctggcctcaagtgatccactcgccttggcctcccaaagtgctggaattacaggcatgagccactgcacctggccctctacccatttttaaattggattacttgtctttaatattgaattgtaacagttctcttttcttttgtttttgagactaggtatcactctgttgcccaggctggagtgcagtgaccccaatcatagctcactgcagcctcgaattcctgggctcaaggtatcctgctacctcagcctcccaagtagctgggactacaggtgcacattactctgcccatctaactttttaatttttttatagagatggggtcttgccatcttgcccaggccagtcttgaactcatggcctcaagcagtcctcttacctcgacctcccaaagtctcggcattacaggtgtgagccaccttgcttggcctgagttaattttatatatggtgtgggtaggggtccaaactcattcttttgcatgtgaatatccaattgtcccactgctacttatcaaaaatactattctttcccaattgaatagtcatgtcacccttgttgaaaatcaactgatcataaatgtgagagtttatttctggaatctcaagtttttttccattgatctatgtccttataccagtgctacattatcttgattactatagctttgtagtattataggttttgaaattgagaagtttgaatcctccaacttttctctctttaaaaaattctatggctattctgagtcccttgcatttccatataaattttaggatcagcttatcaatttctgcaacaacaatgacaaaaacccagctgggcttttggtaaggattgcattgaatctgtagatcaacttggaagtatcgtctaagtcttctaatctatgagtatgaaatgtctttctatttattaaatctttagtttcagcaacattttatagtgttcagtgtacaagtcttgtactttttttgtttgtttttttgagagggagtctcactctgtcgcccaggctagagtgcagtggcacgctcttggctcactgcaacctcggcctcctgggttcaggcaattctcctgcctcagcctcctgagtagctgagattacaggcacccgccatgatgcccagctcacgcctgtaatcccagcactttgggaagccgaggcgggcagatcacgaggtcaggagatcgagaccatcctgactaaccttgaaaccccgtctctactaaaaaaaaaatacaaaaaatcacccgggcatggtggcaggtgcctgtagtcccagccacttgggaggctgaggcaggagaatggcatgaacccaggaggcggagcttgcagtgagccgagatgcaccactgcagtacagcctgggcggcagagcgagactccatctcaaaaaaataaaataaaataaaaaacatgctcacaatacttacattagcctatagttgggcaaaatcatctaacacaaggctattttataataaagtgttgaatatctcttgtaatttattgaatatggcaccaaatgtgaaaaacgaactggttttataggtactccagtacatactggttttgcacgatggtcaagttgaaaaactgtaagtcacggaccacggggacactctatgtacatttagaactaatctaagttcactttcaaatgacactataccacttaacaagtagtacaattactttataacagaatattcccaattcctttgtcctcttccttattgctgtcattcattttacttatccataagctgtaatcactgacacattgttgctattatttgttttgaacaaactgttgtctgtcagttaggaataagaaaaagattttattttgccttcatttattccttctgtaatgtgctttctttccttatgtaggtccaaatttctgactgaaatcattttctttctctctaaagattatctgttatcatttctagcaagacaaactttctggtgaagaattctctcaatttttgtttgagaaagtctttatttctgtttcatttttgaaagataattttactggatacagaagtctaggttcatgttatttttctttcaacacttaaaatatttcactcctctctccttgctcgtgtgattcctgatgagaagtctcatgtaattcttatctttgctcttctgtaggtaaggtagttttttctctggcttttttcagtatttcctctttatctttgattttctacaatttgaatatgatatacctgtgtgtagattttatctcccttgatgtctttggggtttagaaactgttttttttgtttgtttttttgggttttttttttttttttttttttttttttttaaagacagggtctcactctgttgcccagggcggagtacagtggttgcccagtctcaggtgattctcccacctcagcctcccaggtagctgagactacaggcatgcgccaccatacccagctaattttgtttgtattttttgtagagacggggttttgtcatgttgcccaggctggtctcaaactcctggcctcaggtgatccatcctccttgacctcccaaagtgctgggattacaggtgtgagccacggcgcctggcctagacttcttaaataaggcctgagatctgcagttctttgagttatattcccctttgatcatacaggagtcctgtcaatatgaatgacggtaaggtacatggggaggggaagagttctataatcctatgaggagatctcagtctttgagtgagcctgtgccctgggctgtgatcttcacaagtgcttcttggtgccttgccccacttaggtgagacaggaaagctagagagggctggagttgggtattcagttcagctccggtgaaatagtttcttttcaggcacgccttgttgaaaacagtgtgctctgggcttatttcaaaatgacttatttcccctttcccctgccagaagcaggaggggattttttttttttttttttaatcttcactgtgaggacctcatagggctcctagagataaaatgcaaaaatgtgccctcactctccttgctcaagcctgggcccctctggaatttttaactctcagatttaatcatactgagcctcaggaattcctcttacaggttagattttcctaccttcattcaggtttctgtggaggttttgaggtttccgcacctataacttgtgattttttgtatctacctgtttgtctttccaattttgcaggcagcggtttgccctgtgtcttcagttctctgatggatttaagaagagttgtttatactgattttgttcagcatttttcttattccatgaatgaggatgacaacttgtaacctccttacatgcctgactggaaatcggaagttacctgcttagttaaatttattcctagatttcttgttttggggttttgttgtagttgttacttttttgtagttgtttgcttgctgttatattataaatgcattgccttcttagtttttggatttctcactgctagtgtataggaatacaattaatttttatatattggtcttgtatcctgcaatctttctaagcttattagttctaataatgttttaaagaatttgtttttgcgcttaattgctctagatgttacctccagtacatgtcgaatagaatttggaaaagtagaaatccttgtcttttaaattttatttatttatttacttatttattttttgagacagagtctcgctctctctcccaggctacagtgcagtggcccaatcatggctcaccgcagccttgacatcctgggccaagtgatccgcttacctcagcctctcgagtagctgggaaccataggtgcacaccaccatgcctggctaatttttgtatttttgtggagacagggtctcctgatattgcccagactggtcacaaactcctgggctcaggagatcctcccgcctcagcctcccaaagtgctgggattacaggcatgagccactgcgcctggcctaaaatttttatttgttttttggtttttagggtttttttagaggcagggtcctgctctgtcactcaggctggagtgcagtggtccaatcacagctaattgtagccttgaacttctgtgctcaagtgatgctcctatctccgccccacgagtagctcggactacaggtgtgcactaccgtgcccagctaagttttaaatttttgtagagacagcatctcactgtgttgcctaggctgatctccagctactggcatcaaggtattcccccacccccacttggcctcccaaagcactggaattacaggtgtaattctatacccagccacaaatttagtgtttaacaaactgccaaattgttttctgaagggccttttacactgtgttaagaatttggaccccattgtaagggcagtaggaggctattttaatatgaatcctgaatttaatattttgaatttgaagaggttgtcaaaccagagaatctgcctagtgggcaggtgaaactcataagtcagactaggattggagatacagaatgaaaagtcatcagcctatgactgattttggaagctattgtaggaatattttccagggagagtaagaagagtaaggagaaacaagagaacccaggaaagaaccctgaaggtcaccagcattttaaggatgctgagaaaaagctagactcaagaggaaaaccagccaggcatgttggctcgtgcctatagtcctagctactggaaaggctgaggtgggaggatcacttgaacccaggtgttcaaggttgcagtgagctatggactacaccactgcactccagtctgggtgacagaatgagacttggtctctaaaaaggaaaacgaaacaaaaatttgatactatagaagccacgggaaaatgtatttgcaagaagaaagaagtggttggcagtcttggccaaaaaggaattaaggtatgaaatcagtttctccaactatgctctcacaacacggaaaacttctgtgaccaagtgtgtgtttttcctgcactcaccaagcaattctacggcaagtatcagctgggtgtcctgtaattcaactcagttctgttgccatctacctggcatatagatcccatagattgaggggtcaaacctacaagctgcccccaatcctaagccagttgcaagcctcgggttgtttttacctgtgcttctgatcaactggttagaaatcaactttcccatcacctcctcctcagtttcaactactttgctgggacagctcacagaactcagggaaatacttacttacctttactggtttattatgaaggatactacaaagaatacagatgaagagatgaatagggcaaggcatgtgggaaggggcgggaagcttccgtgccctctcctggcataccaccctccaggaagctccatgtgtttagctacccagaagctctttgagcccaatccttttggggtcttgtggaagcttcattacataggcatgattgattaaatccttggccattgacgagcaattcaacctttagcccctctcccttacctggatgttggcaaggtgggactgaaagtcccagtcttctaatcatgccttgatctttcccatgaccagcccccatcctgaagctacataggggctgccagccaccagccatctcattagctacaaaagaaactctcatcactctggaaatcccagggatctcaggggctgtgttgggaagcctgatgaaaatcaaatatttatttcacagtataacaagatgaaattgaaaagtacattagtcttaaagagattgttaatagccttggagagagacgtttcagagaagtggtaaagtaggagcctcattcacagtgggttgcaaaataactagtagggagagtaagacaacagtgaagatggaattttgcctgtgcaagggatagtgaggttagtcaacatccatcgtaatgagaaggagccagcagagagggagggattgataatgcaccaaagttgatagatcaaggaccctaatagtaccagagtggtaaagcataacagagggatagattttaggagacaagaaacactttgtgacatgaggaaaggaagtgaggaccaatgaagatgaagttaggttacagataatggtggtaggaaattgagggagtccacctctgtgacttatagagataacaagaagggtcacttgctaggagtgaaatgggagtgataatactggtaggaagtttgaaaagagtatatattttaaaaatggttgaaaagctactgtacagaataagagagagccagctaaaaaaacagatttctgggttgtattgaggggctagttgggtccataaagcataaattttttaatgatgccaatcttacagttatgtacttttatccagcagagtttagtagtctgggtagagatgtgggaaaggagaccattgtgttcatccaaaactgacatgggagaaagcaatgacatgggagaaagcaatgaatgaactaagcatagtgctctgtaatagacattgaagtcaggtctcaggtctaatcttgactgcttagtgagttaggcagattacttaaccttctctcagcttcagtttcctaataatcatactgaatcatatcagttttctaatcataatcatctattcaggcagattattcaaccttctctaagcttcagtttcctaacaataatcatactgaatcatatcagttttctaatgataataatctgttctcagtgatgggaattaaatggacaagtgaactccttaacgcatagtttgggatacatgatacatgtcaataagtagcagtttttaacattatttgtgacccaattctgtcacttataagctaggtgaccttaggcaagtttctttcctttttatctataaaaaggaaattataatacttgttagggattttcagctgggtatattttgaggaaaagatgtcaagctctacgcctgatacagcctttaacaactcagtaaatgctagttgaagcagaatctgtaaggaattttttagaaaattaggttggaaagttaggtttggaattttggcctttgtcttatcattagtagggtatctttaaaagttcatgagcaggctgggcatggtggctcatacatgtcctagcactttggggggccaaggtgggaggattgcttgaggccaggagttcgagaccagcctggccaacataatgagtccttgtctcttacaaaaaaagaattcatgagccaggagataacataaaagtggtattttagaaatatgcatttataagtagtgtggtaggatctatgtctcagctggatatctccttttcagacaggccttccctaaccaccctgaatctaagatagcagcactccctcctcctatctaatgccttaccctgtatgatttttcttatggcatttatgactgcaattaccttgcttattaatatgttcacttttttactggctccctccactagaatatatgcttcatgagaaaagaaatattatctgtcttactactgctatatctcagcacccagaatgtgcctagcacatggaaggcattggatctgtttgttgaatgaatgaaatatagtaggaactggaagtagagaaactagttaagaaattattggaatgatttcaacattaggacataaagatctggacaggaataatgatagcaatggaaacagaaggaacaaataagaaaaattgaaaaccaaatacatcatgttctcacttataagtgggagctaaatggtgagaacacatggacacataagaggggaacaacacacactagggcctatccgagggtggaagaagggagaggatcaggaaaaaataactaataggtactaggcttaatacctggatgatgaaatgatctgtacaaccaacccccataacacaagtttacctatgtaacctgcacatgtacccctgaacttaaaagtattttaaaaattacaaagaaggatgatttttgacatattagagggcataataagaagcaggcaataagaatgataccaagatttccaaactgggtgattgatggagtgacagtattgtcattgaaggtatctgccttcaataactttttatgaccagatttagaagaaacagtgcctggcatacactgatgggcagtaaatatctgaatgaatgaaacaaaatgggggaagtcagaaggttacatgtaagatacattatatgtttaaagaagcaatagaacatctaagcagatggagaagaaggctaaaattctagaaagaataaagggccttgggatttacaacattcaacagaaaagctgcagccctagagataggcaagcagcaggattatggttttaagaaagtaaagacacaaagacacgcctatagtcccagctacccaggaggctgaggcaggagaatcgcttgaaccttggaggcggaggttacagtgagccaagatcgcgctactgcactccagcctgggcaacagattgagactctatctccaaaaaacaaacaaacgaacaaacaaaaaaggtaagtaaagacatttagttccaggaagggaagagatagctacgaatattacatgcttcagaaaactgaagaaaatggggactagggaagatctttggatttagagatttagaggacatgatctgggaaagaacaatttaaatacagtaatgaagtgaaagtcatattacaaaaggtgtgaagaatgagtggacagtgagataaatttcacccacagaggtaatgagaagagagacactgtggtgatctgaggtggagtcatttaagggaagcttagcttgccttgttttgtttttttatgaatacagaagcatagtttagagagagagcagaaagatccatagcctaagacaattgtcaatttttaatatgcacaagaataacatgggaattttgtttaaaatgcagattgctagcaccacttacagagaatccgattcagcaggtctgcagagcaggacatttttaaacaaataaccctcatcaccaccaacccccaacctgcacccaggttacaactgtagttaagtatttagaccgtactttgactaacactagttcagggagtaattgaagtaaaaataaatggatgagaagggaatttgatttttaaaaaccaaagtaaagggttaagcttcaggaaagagaagaagttcatcttctttattttttaattttaactttaattttttttttttattttggagacacggcctcactttgttgcccaggctgggcagttgctcagtcatggctcactgcagccttgaactgggctcaagcattcctcccacctcatattccttagtagctgggactacaggcacataccaccatgcctgcctactttttttctatttttatttttgtagagacaaggtctcactatgtttgttgcccagcttggtcttgaactcctggcctcgagcgatcctcccatcttgacttcgctaagtgctaggataacaggtgtgagccactatgcctattcatcttctttaaaacaaacggaaaaagaagatggtataagagaaattttgagatgttcggaactgagtttccaggagatttttcaggtggaggagggcaaataaggtttgcttcatttgtatgaccttgatttttttcctttgagtgggaagaaaggttatctactttgggcagatatgagagaactaagagtgtgaagaggtttggaacagctgctctgggggctgcaacagtcaacaaaggatgaacataagcatcgctgagcagcattaagattctgctaagtaggtggcatatgagtttttggtggacccagtcggcagttatttgacaccttttctaggcaaggaatagtcctaaaaacatgtatcttctaataattcatcctggctccatcacctggagtttacttaaacctttttggatgctttcagcctacgccacttcctacaataatgaactttatatatttactgtataaagtatctaaaagttacctttcaactcaaaagatacttcctttgatttgctagaacatatttacatttgttctctccatactgtttaaatttttctggatttgatcacaagacatgtaatgcttgccatcatttcaccaactgttatttctaagaccagccctgttggaggtatatattttcacacgggcaccagaagttaccacccagtgctctattaccatagctgtcaccaagcgaattcagtactctgggttagggcaaaggaaaccaacctgctgagttttctccaggctcgcaaaaacgggagtccgttcagatgaagagggggcgaagcacctgggcactgtgttgttattctactcttaatatatgcaacaactctgagatagataacggaatctccccatttacaatggagaaactgagactcacatgcctgaagtgcttcaggtcatagaggaaagaagctggagagctgaaagtcacacccacctctgtcttattccataccccatactcctttttatatcatgctgcatttggtgggatactgtccagccacttttatttttatgcataaattaacagtgggactattgactaattaacagtttataattgggagcaacttcttaccctgtaaagatcaacaattaaagacatgcagcattgggaatttaacatatggaaaatttttcatctgtttctgtgatcttttaactgtcttaggccattaggttgctagcatgacacatagaaactgtatattcttcatgaggacagataagcattatgaatagcaagaattttaaagttttctgctttttttcattaaattctgatggtacccagcattttagtcttttagtcacagcagtacatttccatttctgacataactatcatttgacacatatagggattatttttccttaaatatgtatctttacattgctcacatggatgcttatcatctgactattcacacactcttgcctcatcttcctatattttatcagtgaatatttattgagcacctcttttattctagccattttgctaggtatcccaaggaaagcctactgtgttctgaaaaattggaattcattaattaaattaaacaggactaacatactatacttttccatccagagaaatgcaaaattataccttgattcaagacaaaatagtttgtccctcccagccatagagaaagctgagttgtttgttacttttagatcttaggtacagaatctgataaagtctaggtggttctgtataccagcagttgaatttataatcgtagagacttgccttaaatatatgatcagtttaggtaagttcgagaaattctgaagtgtcaattatgttgtattagtccgttttcatgctgctgataaagacatacccaagactgggtaatttataaagaaaaagaggtttaatggactcacagttccacgtgactggggaggcctcacaatcatggcagaaggtgaaaggcctgtcttacatggctgcaggcaagagagaatgagagagccaagtgtaaggggaaactccttataaaaccatcagatctcatgagacttattcactaccatgagaacagtatgggagggaaccccccgcccccatgattcaattatctcccaccaggtccctcccacaacccgtgggaattataggagtttcaatcaagatgagatttgggtggggatagagccaaaccacaccatatataaaaatagtatagataatagttatatggagtactacccactgaagggatacatgtttacctgttcccccaagttaggtagccagaagtgttgtgtttgcattgttggcacaacctgtcaacattaataataactaatttattaagtacttctgtgtgccagggattgttcctaagcttcctacaagaataaatttatttaatcttcctaagaatcctgtgaagtgggtacagttgagcatcccaaatcccaaatgctccagaatccaaaactttttgagcactgacatgatgctcaaaggaaatgctcactgaagcattttggatttttggattggggatgctcaaccgtaagtataattaatgcagatattctaaaatctgaaaaatcctgatatctgaaacacttctggtcccaatcattttggataagggatactcaacctgtactacttactctctccatttcacagatgaagaaagtgaggtagggaaaaagataagtaacttgcccaaggttacagagctggtaagtggcagatccccaggcagccttgctgtatagcttactgtctcctaaccattattctatgctacctttcatgggccctcatgttaagagtaactcttcagtttagcaaattattctgcattatatgatgagcttacatataatagcaataatagaccagaagcggtggctcacacatgtaatcccaacactttgggagaccagggtgggcagattgcttgagttcatgtgttcaagaccagcctggacaacttagcaaaactccatctctacaaaaaatacaaaaaaaaaaaaaattagccaggtatggtggtacatgcctgtagtcccggctactcgtgaggctgaggtgggaggattgcttgagcccaggagttggaggttgcagtgagccaagatcgtgacactgcactccagcctgggcaatagaaccagacattgtctcaaaaaaaaaaaaaaggcaataatgtaactaggtgaaaggagagattcagttcttctctgtggtttcttatacacaatcaagattctaatatgttcatagttaattcatagtgtaaagtttgggtattttagaaaaatgtgatgttttctgatgtgactttacaggagtgggaaaggcatagaaaggcagcgctggggctagagcaccatagtctttataaataaaatgtattgtgttatcagtattggctctgggccttgatgggtagtaaaatatttaggaactgagaaaaatgattaggtattagatcctgaaaataaaaatttgctttttgcatttcttaaaaagatttcctacgctaaaagggtggcagtaagtttaaaaaggttttagttactgttttaaaaaaataattgcatagcatatttcatttactcaatagccacatgtggatttttggatttgggatgctcaactgtaagtataattaatgcatatattctatggatcatttatggatccataaaatattctaaaatacttatggataatttctggggaaaaattgcaagtctttttgaatgaatttaggtgtcagtagtaactcattttgatttctttaattctctttgggggccttgtcaagaaaaatttgagttaagagatatatatttttttctttcttcactagaactcttttttttttttatactttaagttttagggtgcatgtgcacaacgtgcaggttagttacatatgtatacatgtgccatggtggtgtgccgcacccagtaactcgtcatttaacattaggtatatctccaaatgctatctctcccccctccccccaccccacaacaggcccgggtgtgtgctgttccccttcctgtgtccatgtgttctcattgttcaattcctggccatatcatcaccatgaaaagcaggcagctgaggaatgtgggatttgagtgcacaggaaagctaaagggacacttcaacccctattaatggctttattgctctatttaaagactagagctattgctctggccaacatggttcttttttgttttttaaactttagtaatacagtcgattctcatgtggtagttatgttctgtaaagtcactgcaaacattgaattagtgaatactggatcattgcccctgggggaaatagggttaggttcctgcaggtctctggtcacatttcatcaactgatcaatacataacctcattgtatgtctctgttttaggacatattatttaatatgtattgattcaattacattaatattatatattaataatcctgtacaagaatatatgtcaacagtattgtgccagaagcactgtaactcatgcctgaacgaagtttccctaacacacatattttctctgaaagggaaaatccttcttgcacttaggaacactagacggcacttgagcactataattgggaccattttaaacagtgaaatcatcagtaaaaggcacaaaaatgtgaaagacgtggcgctgaagagaccacagaaaagacatgcacttactataggagaactgagacaacagagcattgccatgctaagctgcatatgggaacatggctgtcatgtgactcaaatttttttgccactctacacgtggattacgtcctcagatgaccacaaaagtgccacaactattgatttggagcttgcagataaattttagtgagtaggcatatttgcaagtatggaatccctgaataatgaggatcgactatatatattaatgcattctacattttaaaatgaaaagttaaaatataggactcgctcatccctacctttttcaccccctcctggcatctttcctttctggaactactatcagttttctacatatttataaatatgtggacttacagaaatatatataattttttaataaatggatctcatgatatatactattgtgtggtttgcttttttctcatgtgttagagatctttccacgtcaatatacacagaattatttccttttagtattctatactgtttatgcaccataatttttttttttttttttttttttttagacggagtcttgctctgtcgccaaggctggagtgcagtggcacaatctcggctcactgcaagctccgcctcccaggttcatgccattctcctgtctcagcctccggagtagctgggactacaggcgcccgtcaccacgcccggctaattttttgtatttttagtagagacggggtttcaccatgttagccaggatggtcttgatctcctgaccttgtgatccgcccgcctcggcctcccaaagtgctgggattacaggcttgagccaccgcgcctggcctatgcaccataatttaaccattcctgtattgatagatatttagtaatagtgctattataagtaatagtgcggtgaacatctttgtacctgtttctttttccctatatgcaggtttttctgtgggttgcatatgtaaaaatgaaattgctaagctgaaaggtgtatgcacttgaagtttccttagaaaggcagttgtgtcaggtcctctgggaagctgacactgagacagagttaggactgcaaatagttcactgagtacctgtgaaagataggcagtcagaagctgaaggaagggaaagagctcagactgatttacatctaacagttacagcctattcagtggggcactctggagtgaagattgcctattagaaggatagtactaccagttggttagaaatagccaggccctggtactcccatgtattcagttattgacctgtgactgccagggaagaaagtggcctgatcttgaaagacgagggagttaagtcctaaaggcacatcagaactgaactgcaaggtatcttcaagggagatcttgagcagtgtacttccatggttgctactgcagtgtaggactgtgtagcatagcaaataacacagattatagagccaaattcccaaatccaacatctctgtgtaagaaagatgttactctacatctgtgtgcctcaggttctttatccgtacatctgtaaaatggagaaataacagtacctccctcatagggttgtgaacgattaaatgagctgctgtatacaaaggacttaggatactgggatatgttaacactgtataagagttaactgatgctgctgctgcaacatcaacatcaacccaaaaggtgcaccagtttttcttccaaccctctcaacaatgtgtaaaagtatattcatttctccgtatcttttccagtgctggatagtataaatctttttagcttttgaaaatttgatggccccaaaaatggtattttgtcttaatttgcatttctttattaagttgaacatcttttcatgttactggccacatatttaatcttttgaggttttaaattttttcttattaatgtttggtacctagtcatgtattccagatattgttatatagttgtgaatattttctcccagtctcacgttgtttttcaaatttatttttcattattatttatggtttcttttgacaaagatgtttaaaattttgtggatcagtttttttctttatgggttcagggttttctttcttacattgaaaagactttcctactccacgtttatagttctcttttttatgtttagctttgtaaagcctcttgaatttatttttgttcataatttgaaataagtatctagctttatgttttcctcactataaccggttgcccccgtgttcttcattaactagccctttttctcccctgatatttcttgatgctatctctgctgtattctaaattcctatatatatactgggtgggaggatattaacatttttaaaggttttaatatgtgttgccaaattgcgctgaggaaatacatatagaaatttatgtttttactggagagtattttgttgagctccccaacctgtgtttcttgctgttgtttttagtttttgccacgttaatagtcaaaatatagaagttttcttggtttgctttaaaaaaacaaacaaaccaggttctcattctgtagcccaggctgaagtgctgtggcatgatcatggctcactataaccttaatctcctgggctcaagtgaccttcttgcctcagccttctgagtaacctccgtcttacatggtggtatgcgccaccatgcctagctaattaaaaatccttttatagaaatagggtcttgctatgttgcccaggctggtggttttcatttctttggttactggaaagactgaatttttaaaaatgtatatacttttgatgttctgtatgccatcttatatgaattgcttattcatatttttctccatttttcaattttgattttaggtttcttgttgatttgaaaggtatcacatataaagactattaccccttcatgtgtattgcacagaggttattgtttacctttaaatttatggtatttttctttatagtctgactttgtatgtatacctagaaaagttttccctattcctaagaccacaaagtcaactagaatattttcctttttatgattttaatttttatattaatttgccatcttattttgctgcatggtaataagtgggaatcttaattcttttataaatgttaagccagttacctaaaacagtttactgaataatccattctttcctctgatttgtaatgccatcttatatatcctagctctcttggggtgtttgattccgtattgttgattgatgtatctattcctgcaccattactacacactcttcattatcgtggctgttgtatccatgccatggttggagagctcaccttggaaagtaagcactctgtggaagtatcatttcaaaactgactttaattttggaaattaaaaggaaaacccttcttaagctagagtaagtggagtgaattgacttggatcctgcctgggttcctctgtcaacattctgttttgtggtctttaaataacatacttgattaattccattggacatgaggtaatggctgctcttaagctattctaaagctagagacagaactgtacaaaagaattgtcagcaccaagtactttaatttaaaatattaaactaaaaaaaatagttccaatgttttagagatacctttcaggttaaatacaattggttaggtctgatcatttctatgaatagaaggaagtattgaaggtaaacctgtttctagagcagagattctcaactagggacagttttggccactccatctcccagggacatttgacaatgtctcaagacatgttgattatcacagctgttagagggagagagtgctactgacttctagtgagtaaaggccagggatactgctacacatcctacagtgcccaagacaaccccagcaacaagtaattatttggtccaaaatgttagtagtgggccaggtgtggtggcttatgtctttaatcccagctacttgggaggctgaggcaggaggatcacttgaggccaggggtttgaaatcatcatagggggaccccatctccttaaaaaaatttttttaagtagatggatgtggtggtacatgcctgtgtcaggattgtctaagtcttagctacttgggaggatgaggtaggaggatcacttgagcccagaagtttgagactacagtgagctatgatccagcctgggtgacaaagtgagactctgtctcttaagaaaaaaaaaaaaaaaaaagtgaatgctgctgaggttgagaaacctactgtagagaaaactcaaactgagagttcattttttagtgcagtccagtctgacaactgctgtgtttaatatatgcacaagtaatttactattgaagtaagagaagacctttccaaaagtatggtacaaaacctagaagctataaaagacatgattattaaatttgactctatggctgggcgcgatggctcatacctgcaatcccggcactttgggaggccaagacaggtgagtcacttgaggtcaggaattcaagaccagcctggcaacatgttgaaaccccatctctaattaaaaatacaaaaattagccgagcatggtggtgcacacttgtaatcccagctattcaggaggccaaggcaggaggatcacttgaacctgggaggtagaagttgcagtgagccaagatggtgcctgcactccagcctgggcgacagagcaagactccatctccaaaaaaaaaaggactctacagaaaaataaaatttctacatacaaaaaaaatctaccataaacaaaagaaaaataacaaactaggctaaaatatcaataggtcaaaccacagacaaatggctaatttccttaatatttaaagagttcttgtacttcattaagggaagtaccaacaacagctccatgccccttcccccatacctcaccctacacatctcttcatctatatcctttgtagtatcctttatattaataataaatcaataagcataagtgattcactgagttgtgtgacttgttccagcaagttaattaaacccaaaaaggggattgtgggaaccccaacttgaagccagtcagaagttttggaggccccggcttgtgactgactggtgtctgggatggggtgggtggcagtcttggggactgagccatcaacccatgggatctgatactatctccaggtagacagtgtcagaattgaattggaggacacctggctggtgtccactgcttggtgtgtgggggagaaaccccacgcatttggtcacaaaagccttctgtgttgctgtggtgtgacagaaaaaaacatggtttgagagtttttttcctatatatatgtggaataatttggcaatatctgtgaacattttaaatgcatatactctttaacccagaaattttatttctaggaatttattctacggatatagtttcatgtgtgaaatgaatttcgtaacgataaattaggctgtccattgttattgtttgaaataacaaaagactggaaataatccattaaagggaaatattggagagttgcctcaatagacaactgtacaaatacagtatatctatatgctagaatactatgaagccctttagacaggatgaggcagccctgtatatgctaatatgtaagattctctattatatgttattaagtaaaattgccaggcacagacagtatcaggtattggcaagaatatgtagagcaagtgggacccttatacactgctgggagaaaagtgaattcggacataacccctttggaaaacaatttggtattatctaataaaatttaaagatgtgtatgaaccttataacctaccagttttacttattaacagattctagaggaattcttgctcatttccccaggtgacagaaatgttcatagtgccatttataagaaaacaaaacagcaacaaacttctagaaatctgtgtccagagtagaataaataaatgttgagaacactatacagccatgaaaaataaataaattataacaatctgaatcttaaacagtcatgttgagcaagagaaacaaactgtggaaacatacatgtaataagattggattccatttatatgaagtttaatataattcattaaactgtatgaaacattaaacatgttgtttagggggaaaaaaaattgtaaaactacaagcaaggaattaataagcacaaaatcaaggagagtggttacctcaggagagaaaacgagattagagagggcacatgggggattcaaaaagtaatagtaatattctctcatcttctttttttttttttttttttttgagacggagtctcactctgttgcccaggctggagtacagtggcttgatctctgctcactgtaacctccacttcccaggttcaagcgattctcttgcctcagactcccaagtagctggtaccacaggcacccgccaccacgcccagctaatttttttttttttgtatttttagtagcgatggggttttgtcatgttggtctggcatgtctccaactcctggcctcaagtgatccacccacctccacctcccaacgtgctgggattacaggcatgagccaccgcacacccagcctattcttccttcttaaactggcatgtggatgcatgggggttcatgatatgatagttttgtttaaccttatgcaattttagaaatattttatatttactaattattaaaaataagttttggaaagtaggtattgaacattatatatgttactgtgactgcatgggtcatttaaaaaataatacacagacacacactcatgctcttgtatatgcgtacattatccctcctgtaaagatacacaagaagtggtgcttgcagccaggcacgggggctcatgcctgtaataccagcactttgggatgccaaggcgggcaaatcacttgaggtcaggagttcgagaccagcctggccaacatggtgaaaccctttctctactaaaaatacaaacattagctgggtattgtggcgggcacctgtaatcccagctactcaggaggctgaggcaggagaatcacttgaacccaggaggtggaggttgcagtgatctgatatcatgccactgcactccagcctgggcaacagagggagactccgtctcaaaaaaaaagaagtggttattgcttcaaggaaaagaaacggagtagttggaggcccattgttgaaaggaaatgtacttatcactttatgctatactctttttgtctttgaatttttgtagcaaatgtatatagtacatattcaaattttagttttaaaaatgtgtgtatagagagaaaggagagtcatttatcatttgcgagagacagctggggaaattccagtatcatttctaaccttgatgactttgcaggttttgccaaaccatataagaaataaaaagaagacacttttttttttttgtttcattttgagccaaagtgtccctctgttgcccaggctagagtgcagtggtgggatcttagctcactgcagtctcgatccccagggcttaggtcatctttgtgccttagcctccctagtaactgggactacaggcacatgccaccacacttggctgatttttaaattttctgcaaagacagggtctcactctgttgcccaggctagtctcgaacacctgggctcaggcgatcctccttccttggcctcccaaagtgctggacatacaggcatgagccaccacacccagccaggaagacaaatttttgttgagaaggtatttcacctctcatgccaatttttccttgaaagttagattccatggaatataatttatcaaatatcagtgatactctactcttagcccttatccaaagccttaccaaccttacctctctctttatattgtttactaaggagtctctggaattttgttcatgttttttaacatctttttgaggaaaaataactttcttaattctcttcataagttctcttcaattcttagtaatcagtacttatattagagcaatgctgaacaatttaaatgcacaagtatctcaccaaaacctttattcaggccctacctgtgataggaaacaaaagtcagtgtctgtacccactatcttgactatttagaaagagaatctactaattggacacctttctttttccttaagactgttcacagatttttttttcacattttcattttagagtaataatttgggtcttattactaaattaaaattatttaaacatgtcaaaggcatttatctccataaagtgtttaatccattctagtttgtaaagataggggttttttttttttctttacatttattatgtctggtatagatgattaaaactttgtaagcgtaacctgtatttagctgagtcaggaattctcttaatagtgtaagtctctagcccactgaaaagtcttgccttctctccatttgtttttgagggtcaacaagtctggtcagcttctgtgcaacatcatacatcagtgtattaccaacggccactgcaaggattgatgctgtttccactgggtagcatggcatccgcctggtcaccttagtcaacacactccttctgcttctgtgtgtgtgaaggagtcaacacactccttctgtgtgtgttagtcaacacacaccttagtcaacacactgcttctgggtactgctacatccacaccactgtttcctctaggttaagtgttgatatactgttatctcccaatgacaggacgctgaaatgaactacattatgctctactgaaatagtttcattttatgttacaccctgacatttacagtaccacaacaggattgccacttcctccagtatcttgcaaacttttaaaggaactagctatttttcctactacccttgcatcctccttgtgcttagatacaaatccaccggaggcaaatacaagtgacaccatgcagtactcagaatcactccttctttatgatggatggtaaagacttcattactagcttaactttgcttcctagactttttctctcatgaaagtaaattctttccagaacaatcatcagtctttaatgcaaataagttgcttgaaaaagatttatccttgcagctcaagtcccaaaaattctatcccatatcaggttttgtaatggaaagtggatcagtaggtgttgctcacatagcaagctgatacttgtagtcatatcaacctttagccatcactttagggtggaaaagaaatgacttttcattatgcctctcttatatgcctgtgtttttcactaactttagaggaagagtagttaggcagccttactgacttgaatagtacaaagcatgccaaaactgtgaagctgtttggtgatatgtcctccacactgtggtcccaaaagaccagtaaacctaaagggactaatatgggccggcagggggcgaggcagggtagaaccttggggtatattcctgctttcagagaggtggcaaaagtaagcctggataccctgtgctagactttgtagctttgcccggaagccctctctatttggggactaggcttatttagttctctttctaaaacgttttgacaaatataacttatattctaggacatctgccactgacgcctgagttcagacattaattgtcaattctgtagtctttttttccttcaagtttctcttgtcgcttccttttctccctcctttctttctttctttttttttttttttttttttttttgagacagtttcgctcttgtcgcccaggctggagtgcaatggcgcgatctcagctcaacgcaacctccgcctcccaggtcaagcaattctcctgcctcaggctcctgagtagctgggattacaggcatgcactaccacacccggttaattttatatatatatatatttttttttggtagagacggggtttctccatgttggtcaggctggtctcaagctcccgaccttaggtgatccgcctgcctcggcctcccaaagtgctgggattacaggcatgagccactgtgcccggccttctccctcctttcaaattagacaaacaaaaatattttagtgtctctctgatttctctatgtttacatttcactgtcccaggaaccagcctagtccgttaggaaccaacatactccccaagacacatctcaaatgacagtttgctggccatgttaaaaatgcatttctgattctatttagggatacctttagtccatgaaataaatgagaacattatcaggattcataattattatctggatatgtccctaaaatatagcatgttttgctgacttactgaaatacatatttgtttctagttttttctatttcccttcctctcaaatagttaattaaatagtatcagtgacctaggaaagtcactgttcaaacaattccttccttaaaatgaagaattatcgactattctctaacttagtattttagagagagagagagagtataatgtgaaaaaatgtggtgtctttattcattttttgttgctataacaatacctaagactgggtactttataaagagcagaaattatttctcacagttctggaggctgggaagtccaagatcaaagtgccagcagcttaggtgtctggtgaaggaccaatctctgctttcaagatgggtccttgatgctgcatcctcctgagggaggaacactgttctaacatggcggaagagagtgaattcattctcacaagctctttttatggcagcatgaatctgcttataagagtggagtcctcatgacctgaacaccttccattaggctccacctcccaacacagttgcattgccgattgtttccaacacatgaattttgggttgcacattgaatcacagcatgtgagttctcaaataacagacacaaaagttacatagaagagattgatagttcattcacttaatatttattgcagacattatatgtcaggaactctgctaggcattagatatatattggaaaataagatagatactggccatatagagaacttatctagcagttaacagacaacaaaaaaataaaaataaatataattgtcatagtgctataaagggagaaatgtagttttaacaggaacctattaacaggaagaatttacgagggaagtcctccctaggaaaatgacatgtaaactggaaatgaaaggaagtgcaggagttagcaagaacatgagcagggaatagttctgccagcaaaaagaataatgtgcaaaaggccctgaagtggaaaagagtttggtgcttttaggagctgaagaaaaccaatgaggctaacttgtgtagagccaagtggggggagtgagattagatctgtctgaaaaaaaaggcatagttcaggtaatacaggacctggtaggccattgtagagattttgttctttatcctaacagtgatggaagccattaaaatgtttaaggtaatgtgacaaaaatcagattgcatgttagaaacagttgttctaggccgggtgtggtggctcacacccataatcccagcactttgggaggccaaggcgggtagatcacaaggtcaggcgtttaggaccagcctagccaacatggtgaaaccccatctctactaaaaatacaaaaattagccgggcgtgatggcgtgctcctgtaatcccagctacttggggggctgaggcaggagaatcacttgaatccaggaggcggaggttgcagtgagccgagatcgcgccactgctctctagcctgggtgacagagcgagactccgtctcaaaaaaaaaaaaaaaaaagaaagaaacaattgctttgcagtatgaagaagaaaggattggaagggataagaaatgagtgctgagaatttactttgacttgggttgggatgttggacatgtagacagagaggacaggatagacttttgtttaggaggtaaattccacttgacttagtgatttcagagtgggaacctatgggggaaagaaggggaaggagttaagaataactgacctgtgcaactggatgaatagtggtgccattgagaaggacactgggaggtttaaatggaggataagttcgttttcgtatttgttgagcttgagatgcctatgaggcatccaagtggaaatattaagtaagcaataagcaggaatctggagcttaagagagatgtcttagctagagatcaatttgtgagtcattgtcttttaggtgataattgaatcagtgaacccagctgagattgcctaggaagaatatggagtgagaagaaaagggcagcttgggaacaaacttgacaactctttggtgacgttctgtataatttttattctgaacagactttggttttataagaattgtactttgaaataaccttggttgttttaactgagactttctgttgtgatgtagtaaccctctctctctcgccagatatattgtcatctttttattttttgtatataatctattatttattcaaacagtgaatagacttggccattcattgatcatccagaggtaatataagtgatgttttctaagcatctgggttaaacagttttgtctagatacagtagtaagaaccattcttactatattcttgtcctataaatggttgaggtgacagaatgtttagctgtctgttcagatgtaataaggaaggttgaattctccttggcagccttttttcatgagttgttgggcatctctcagagacagctctagagataataaacgtttattattctggtgtcctgactgatgtcatctcttattgcctaagcctcagtctgggattaagatggtgggtgtattagtccattctcacactgctataaagaaatacctgagactgggtaatttataaagaaaagaggtttaatgattcacagttcagcatggctgggaaggtctcaggaaacttataatcatggcagaaggtgaaggggaagcaaggcaccttcttcacaaggtggcaggaaggagaatgaacgcaggaggaactaccaaacacttataaaaccatcagatcttgtgagaactcactatcacgagaacagcatgggggaaatcacccccatgattcagtttcctctacctggtctctctttcaacatgtggggattatggggattataattcaagatgagattttgggaggggacacagccaaaccatatcaatggggttttccccctttgccactaagtagccacagaaggcaggataagaaattgacaaattggccaggtatggtggctcatgcctgtaaccccaacactttgggaggctgaggcaggtggatcacttgagctcaggagttcgagaccaggctgggcaatatggtgaaaatgtgtctctaccaaaaatacaaaaatcagcaacgcgtggtggcacatgtctgtggtcccagctactcaggaggctgagacagtaggatcgcttgatcccaggaggctggggttgcagtgagccgagattgcgccactgcactccagcctgggtgacagagtgagactctgtctcaaaaaaaaattgaaaaattggactcaaaatataaaacatttgtccttcaagagccattgctaagaaaatttaaaagcaaggctatgggggaaatattggtaaaacacatgtcagaagatggacttgtattcagaatatttggaatatataaagaactctttaatcattggacaacttgacttttttaattgataaagattttaacaggccagagatggcaagtaaatacatgaacatatgttctatatcattaaacattagggaaataaaaccacagtaagagacctctacatgcctacctctacatttttagaatggctaaaactagaaagattgaaaatacaaagtgttgatgagtatggtgaacaactagatttttagatattgctgctgggaatgtaaaatagtacagctggccgggcacggtggctcacacctgtaatcccagcactttgggaggccgaagcagtccagtcagttgaactcaggagttcaagactagtctggccaacatggtgatactccatctctactaaaaatacaaaagttagctgggctttatggcgcatgcctgtaatcccagcaactccagaggctgaggcaggaaaatcacttgaaaccagcaggcggaggttgcagtgagccgagatcgcatcattgcactctagcctgggcaacaggagcaaaactctgtctcaaaaaaagaaaaaaaaaaaagaaaagtacagctactttagcaaacagttgggtagtttcttataaatttaaacatacacttaccatatgactaagcttttcactcctaggtattaacacaggaaaaatgaaaacgggtctttacaaagacctgtatgcaaatgtttatagtagccttattcatgattgcatatgatttcatttatataaaattctacaagaggcaaaactacactgttagaatgtagatctaccttgggagcttgggggaggaggctaactgcaaaggagtctgggaactttttatggtgatgcacacattctatatcatggttgaaatggctacatatatttgtcagaactcattgaattgtacattttaaaatgtgaattttattgtatctaaactcgacctcagtaaacctaatgtcagcatttgtgaagggttatcagaagccttttaggatatcacttgtaaaatgggacagtagaccaaaagacaatgaagctttttgctcaaaattccatgagtagtggtgcctgtggatagaatgcttatgttcagattcttaatcccacacgactgcacaattcccttggcattaactcacaccctcctatgtattgtgctttttaactttctgtggatgtgtgtctggctgtgtgtatggaagttctggaaacacaggggtcatgtcttcatgtgtccttcatacatcctacagtgtattgcacagatcttgtgctcagtatttgcggaatgaatgaaagcttggtatagcacgcttgtgcccactagacttggacagaaaagtcaggcatagctcatggtgtggtgctaggcttctcaagatcatgagaaaccttctctaaagtatggtttttctagaccaccatctctttgcttaggagatcatggctaccacaaatgtaagctaattaatgagggattgattttatatatttctgcaaaagcttaggtagtgttttcagaagttgaaaattggggagatatcaccttacatttttaatcttatgctgaatttaactacaatgagaaaacaagctcctcttaaagattaaatggaagaagagatgtcagaactagaacttttgtcattctccaaagctctccactcttaaatctatccactttataattgaggcatcacactgatggcacagagaaacacttgtctcagtgttaaacttgctttcctcatatttgtgaggctctaaacttttacagttctgactcatttaaaaacaagtggatctacataaattggacatgaattcatgatttttcttctaagtctaaaaaagcaagagactcagaggtactatgagacaacaataaatttaagagaatactaaaataaaaaatatataaaaaagagaaagatagaatcccaaactatgtttctcttatttcttttttttcttttcttatatttaatttatttattttagagagagggtctctgtcacccaggatggagtacagtaacatgttcatagctcactgcagcctcaaacttctgagctcaagcaatcctcccacctcagcctcttgagtagcttgaaccacaggtgcacatcacgatgcccggctgatttttttagtttttgtagagataaagtcccagtgtgttgcccaggctcaaactcttggccttaagtgatcctcctgcctctgtctcccaaagggctgggattacagatgtgagctgagccatagcacctggcctatttccttttttaaaagtatatcgacatagcaacacattattgataatatttaacatctatcaagttcttactctgtgccaggcatttgttctgagtgctctgtatacattctctctcttaatacacacaatactgggaggtcattctgcatttactgaggaagctgaggtacacagaggttaattaacttgcccaaaatctcacagccagtaagtggtagacctggatttcggtcttttttcttttgagatgaagtctttctctgtcgcccaggctggggtgccatgacgcgatctcggctcactgcaacctctgcctcccaggttcaagcgattcttctgcctcagccttctgagtagctgggattacaggcacatgccaccattcccagctaattttttttatttatagtagaggtggggtttcaccatgttggccaggctggtctcgaactcctgacctcaggtgatccacccgcctcagcctcccaaagtgctgggattacaggcgtgagccaccgcgccttttttgagaggccagatttgagtcttaatccagaacctgaactcgaactgctgatatgctatctacctgtgaagacaacacatacatgactaaatggtttagaatttgatttaatgtcagagaattactgtactcatgtaaattgttaaggaagtacaatttagtagagaaatgatttaaagttgtttaataccggaatatcaactagttgaaaaagagcagttactttaacagacctggagatcataaatggatcctttgctcttgtgactttataaattcctgagaaggtagtagtgcacattttctggtcgatgcaaataggtaagacaaatgtgagtgttcattttgatgtctgagagtagactataaatagccaagtttccttggagataggataagagcctaaagttgatgtagggaatccttttgttcttcagacaaagatattgggatgtttctttaaggagaataaaccgagagcagggtgttccttgaacgtttatgagaaatagtggctagtgtaggaagaggttacattttataaggaacaaaacccaggggagcctctcctgtgaactgacaagaggaacccaaagatgacatctccctctatatatatgtttttttacctcccatgaaagtccttagatgcactatcactgtgcttacaaaattgtgattaagtctgttctgatagaagtctgaatgttcctggaggtatttttaggaatactgttcattttctttactcaatgaatggtgttcagggaagttagcatcatgtgctaggaagttttgaagtgggtaattcaaaacctgggttttagtctcagcgctgctaattaactttgtatccttggattaatcatctaatctctctgggcttcagtattttctaaaccctaatttggggagattagaacagatgatctctgagatccctgccagctctaaattctctaattttatgactgcttttggccaggagctttacttgagagctgctattgtctgctcattgcttgcttgtttcttgatcattgtccacaggcagtccttttctgtgaggctatggggtcattaatgtttagtctttttgttaaaatacttttacagataattccacagtacttttctggccacaagaattaacctaccaaatttaactttcattctctttaccagtctcaccttaatccagctcagttctgtgtacaaaccatggaggttattcattcaggtgaaataaatgggttacttctgccagattaatctgggaagaaacagtaagtatccttgaatggaattcttccatgggagtttctcttgataccctaattgaaatggaatagaaaatgcagacattgtaatttaaattccattttaaccttctacctgactcactttggtttatgctaatttctttggcatactcttaatttcttttagatccagagcatgtgcttaaattcatacatgattgaaagatttcatagtgtgtaatgtaaatgcaattagcacacttaaatttaatgtgtaatatcgtataaacattttagaattttaaaatttaaagcaaacattctttttttttccaaagacagaattgtatggatttatctacacttagataagacagagtaaaaatacaaaggttctcaccccctctccccacgtcacctccagttctcttcaaccagagtaggctactcttggcagtatgacaaatatccttccacatattttctatacattatatggatagtttaaacattgtggtaagcttttctttaatgaattcttcatgcactatatgttaagagcttcaataattggcagagtcatagtgccatagtgaggacagattctggtagcatgttgtacttgtcaataaagcagattttaaactagagatttgctgctagttagtatttaatgtctttatgggattaaacctaaggtcactttagggagcaagagctaataagctgtaatgtgagggcagtgttgggtatgatttagtcaactgtaaaataaggcctccaaactacagtcatgcttacaaacaggtggtaatagttgtcttttaaatcgggatagagggaacagccaacaggatgcaaggaaaaagaaaatcaaacttaaaggctaatgatcattttttacttgttatataacaaacattttgttatttcattataatagcaaagctttctcaatctccaggcttccggcattggtattacaataaaatccatccccagagcttctatttcagcaagcctgaacttgccttgtgtgtggtcatcaatctgaataatatactaaaaagttgaacagggaagtaatgtcctgactactttttatgaccaatagccttagcaccctttttatgttggaatgcaagtttcatgagtacactactgtgttaaattggtgtgtcttgtactgtcctgtgtatgttttaacaaaaaaaaaatatatctaatttcttttcctgaaaactattattcagtgcttacagttctgattgccttccaggtgttatctcattatcttgtttaattctcacacagacctaaatggtggttgtactatttttttgctgaagcaggcttggaaagattaactgacttgcccaaattagtgacaaaactgaaattcaaattgtgacctgttgttgagtttaatttctggaatggcaaagtaaggacctccaaaaatctgctcctctataaaagcaacaagtacactggcaaaattattaggtcaaccttttcagaactctggaaattaaagcttgcaacaattgaaggagcattcgagaaaattgcctgtatttgggtaagaaaagcaaactttgtggcagtttcaattgtgctaattccatctacctgtccccagtacccttgaaaaccagtagcctcacagctatagtagctgtgaaaactagcagcttagcaaccaattgagagggcagggggtttggtactttttaaagccccatccccagagaattgtcactatttgatcggtctggcagctcactgaaaatttcaatttttagggcttatctttgtttgatcagattcagagtttgctctgttctattcctaggcatttgttaaaaacagtcagcagttgttcagcatcacaggttcctgaggtattggggtaacaaaagactgacaggcaaacataaaggaaaatttgaggaatagaatgtccataggagtctttgaaaagctccaacttatttctgggaacctgaagggccacacacatgtttgggactgtccacatacccaggcaacaactgggaaggccctactctctcacctctacctgatttaggactcaatgcaagcaggaagtgagggccaaggcagagttgtaaattgtctgctgcagcattgatgatgtgccacagcacagagagagaccccctcagcaaaggctgagagtcttattggttcaaagaatgtaaagaaaccttattctaaccattagctgactactaaactaatctaatagatgaggccacacgcaacaaaggatacagactttacagaatgattccaggaaggttagtaaacagtaacaacaacaaatcctggggaaggaaggaatttgatttccatagttgtcacattatattattcaaatgtccagttttcaactaaaaattacaagacacacacagaaacaggaaagtgtggcctatacacaggaaaaataaaagcgttcaatagaaactgctcctgatgaagcccagacattggacttactagacagagtttaaatcagctgttgtaattataaatatgttccccaaaataacaaagaattaaaggaaagtttgaaaacagtggcttaccacatagagaatatctaataaagagatagaaattattttcagaaataaaatagaaattcaggagttgaaaagttaaatagctaaaacaaatcagaagtagaaagaatcatcaaacttaaagacacatcaattgagattattgcatatgaggaacagaaagaagaaataatgaaaagtgaagagaacataagaaatgtgggacattatcaggtatatcaacatacacataacgggaattcctgaagaagagagaaaaaggagcggaaagaatgtctagaaaaacaatggctaaaaactccccaaatttgatgaaaaactatacattgaaaaatctaagagattctaagtaggatagactcaaagtaatatacattcagaaacatcatagttgaaagacaaagacataagagaatcttgaagggagcaggaaaacagtgaatcctcatatgcaagggatcttcaatactattaacagctgacttctcatcaaaaactattaggccagggaacagcgggacatgttcaaagtgctgtatcactctcggctggatgtgttatggtggctcacgcctgtaatcccagcactttgggaggccaaggcaggcagatcacttgaggtcaggagtttgagaccagcctggtcaacatggtgaagcatgttgtttagtagagaaacatctctactaaaaatacaaaaaaattagctggacgtggtggcacatgcctgtaatcccagctactcaggaggctgaggtaggaggatcgcttgaaacctggtaggcagaggttgcagtgagccaagatcgtgccactgccttctgcctggacaacagaatgagactctgtctctaaaaagaaagaaaaaaaaaaaaaatcactgtcaatcagtaattctatatccagcaaagctatccatcaaaactgaaggagaaatgtagacatttcaagataaacagaaatggagacaattcatcacaagtagacatgttctataggaaatactaaagtgtgtccacaggctgaaataaaaggatactagtcaatattttggatccacataaagaaataaagagcactggtaaaggtaactatgtaggtaaatgtaaaagtcagtacaaatatatttttgcttataacttttttattttaaatcaataattataaaagtgtgttaggcttatagtgtatacatataatttgcataataatagttcaaagacaagggagagaatggagctatattggagtaaagtttccgtatgctactgaatttaagttggtatttaaatgattgttggatttcttttgaggtaatattcaccattttaaagtgtacaacttatgaagtccttaaaatggcctaaaaaataaaatgtacaacatagtggtttttcatacattcacatatatggattttcttatagtattgtgcaactatcaccaatgtctaattccagaatatttgtaacattccaagaaaaagaaaccctgtacttcccaatttctttttcccccatcctctggcaaccactagtctattttctgcctctttggatttgcctattctggacatttcacataaacggaatcatacaatatgtggtcttttgtgtctggctgctttcacaaagcattgtgttttcaaggtttatccatgttgtaacatgtattagtagttcttttttttaattgctgaaaaattcattgtatggctattttgttttttattcatcagttgatggacatttgtattgcttctactttttggctattatgaataatactgctatgaacattcatatataagtttttgtgtaaagatatgtagtctcttccaaccccaagttggtgcactgcaggacaattcaattctgacactaatcacctggagttagtgcagacctcacaaattaaggactcagttctccacaaattcagatgctgcccccaatgcagatgctatccacaaggtcagggggtccccaggctacctctgcttctcactggctacaactttaggggttcccatgatctcttcaggttcagtaaggagatacagtgctttgataggagcccagaggacaagcactcaactcaggatgggagtgtaagagcttgtcaaggaagatagcccaggagcaacttctaagctgcaactggaatttctagtcataggtactagccaggaaaagaggtttgatagagtattgtaggcagagggaacagcatatatgagggcctggggtgtgtataatataaggagatatatgaattaggaattaatctaagaattagagcatcaagtatgaaaagaaatgaaagactagaagcagtataatccagacctttacagcccattttaaagagtttggatttaggacagagagtcactatagaagagccagatccaagaaagatccctaaagaacacaaaattttaacaaatgggaaagaaaaaagtgtgtatgaaaggaggagaaactaaagaggcaggaggaaacccagtagatatggagggagttaccaaaaccaaaggaaatgtgtttgaagaagctatatcaaatgctgctaaaatgtttttagtccaggactttaaatgttaagcatccattagagttggtgttatggagtgagtgagcttcacaagagctctatcaaaatggtagttggggcaaaagccaaccttcagtaggttgaagagtgaatgagactctgggaagtgaaggcagcagaggaggaggaaatctggccatggctgggggcacgggaggttagacaaagcaagacagaaacagaaagcatgatgcccctggaggacgtgttggcatatgggatagttttgttttatggtaggggagacttaaacacattcaaacatttttgagatccagaagaggatagatatgaaaagagaaaataatgtattgggcaagatcccaaagaaggggaggatgggatccaaaacacaaggagaaaggattgtgagaatgaaagaatgaatgtgttcagatacatttgtaagtttgatggtagacagttgaggatttgctgtctgatggcctctacttttttctgagaaataatagagactgatacctactgaatatgaaggaagtggtagattttttaaaggagagtgcaggagtcttggaacagcctcagcaaagaacagtgaagcacggaattagtgagacctaattagtttctagacagagatgacggccctgagattaaaatttagaaatttacagcagcacccgtctgctctgatgtgattttctccatcagcattccacagcctgaaggttagtacaagaaggaagaaatttctattgagtcagggctatcatttttgccaggtgggtgcatgaaaagataaaaggtggtaacataatggatcaaggactctaggctgggtagggaaagacatgaaggcaagaggaaagtgagagactgggagaaactgtaaggatgggtgactgtaaactcccgggagggtaagaacaggtgaaagtcacaggaaggcatactacagtggagagtagggctcagccccagcctattatgttactcaggttttcagacactgtccatgtgtggctcattaagtttctttgatttacctgttcactctttttttttggccagtttgctatttataagcacctatatcctaaaatacaatttagaaatcatagcagataaaaatcatcaccactagctatgtttctagaggaaaaaattaggtgtgtgacgtttttaagttacccgtaggctgttgttttgtttttgtgcttctactcattcagagggcgagctgccagcgtctgacttacccagggaggtgcacagggctgtgtacactggggtctttccccttcctgctccccatcttcacgtgcaatccaattctaaatttcttcagccagcccattgctaaaacatgaaactccgtaatttcagttcaattgggatactacccctcgctcaaatacaaatgctcttgggaaaggcagtatgttaagcttttatcaatcattaagacatttgtggtagagtattttttggcctgtgtaaccagtgaaacagcttgccaagaacagattttatttccccaaggaggaagtagagcaagagatccacatctgtggtagggattgggcactccaaatcatagtacctagagctgacagggagagccccgtgagaggaggagagcattgtccggaggaggaaaacgtaacagggagatggaagaagataatagctaatgttaacttcgctatttttgctcaaatccaaccctgtatgggaaaacgctctctctggccaggttggcaagcactccacatgatttgctctgacagactggtggccgtgcgcctttctgccttacagcccctgtgttacagattttctgtgacactgcttttacatgtagtgatgacataccttataatcatcctcactgtggcaacagacatgctcagactggctgtattaaatcgttttaacagtgtctggatttacagatgatgagcgtcgaagcttcttaagatgcccccacttaatggagtaagactcaggatgactttccttttgtgtgttatgctgcacaggtgagatgctgagaggcatgtgggatgctgtagtttctagttccatttcctttttcctattgtgtacaagtcttttatttggctgggttagttacctaggaaacagctgcagggtacagatggattggctgtttggggaatggaattacaggccccttcaagaggcaaaaagacctgttggataaaacaaaaattcgtgaatggctgagcttgtatttaataagtgtgcagaaaccacattaagatagctctacagtagagaacttatttaatgcagtgcgattttaaatttagcttgtttttaatacatttaaactcacttaatgcttatgaattccactactgcaggccattttggggtttccagtggagtggaaggtgcagttccctcctctgaaaagctcatgtcctgtttggggataaaaagaagctaccttaaagtaagtgcatggttgtatgatacagactaaatgtgttaagggaatttagaagaagtaaaagatcttgactattaatgtgggtgatgagtctgaagctcaaggaggtaattccttgaggtaaaatattaaatttgaaggcctggtgaaagttcgggtactaacagacctgaatttataagatttaatagtaacagcacagttagccttgcaaattcccccagtcagcttacagaaaatatatgactgtgttataaatgttgtcaacttagagtctcactcaagaaaatgaactttaacaatgttgactgaccactgtttgcattagcccttgcatatttaaggaaagtctatttttactgaatgtgtgagcatattagttgttgaatctctgactgctactatgctgagcacgagagagactcagcaaaatatttgtgtattggctgggtgcggtggctcacgcctgtaatcccagcagtttgggaggccgagacgggcggatcacgaggtcaggagatcgagacgatcttggctaacacggtgaaaccccgtctctactaaaaatacaaaaaaattagccgggcgtagtcgtgggcgcctgtcgtcccagcagctcgggaggctgaggcaggagaatggcgtgaacccgggaggcggagcttgccgtgatatcgcgccactgcactccagcctgggtgacagagcgagactccatctcaaaaaaaaaaaaaaaaagtgtattgattttcttatatacagtatgccttctgtttgtcgattagcattagctttttttcttctagaatagagctgctatttggttttgatttattgtgataaggaatttgataaatacaggactatagctattcttttaaagctaaaccgtggtcagattatttgcagttttatagaaggtgttgaaattttcgtgcttgttctgtttgtagtcacttggtgtggtgtgctagacagaggaggaggaaagcaattccactcagaatctacaggcacaggaggttaagttaaatttcatttctaacgctgagagagtaagaaagtcaacataaggatactcaaatatttagaaggaaagttcagttatgatgtactgaacctacaatttttaatgtttaccagcaaaaaaaatcaaatgtaaatctaagttcactaggtatgtagttacctttgtaactgtacagactttgtatgttaaattgagaagaaagttgctaatataataattcataatattgcattttgtcagagggtctttcattgccagcagttacatcttttataaatggaacagtgactagaaaaggataatttgttaacggtcttttgctgaatgatcaggaggagtttcctgttaagagttctcgagcactgctgtgaatgccttctttatttccaaaattacaagaaaatgccttatcataagacactccctcaagtttttttttttttgttttcaaggagactttttagtgtttttgtttaagaacagtcatgcaattccctggtgcctactcacctctaccaaatcctctcttctggtttcaagcaattaccgtgaaacttaaaaggttagcaataaatagtgtgacaattttttttttttactgatttacttctctttggcctatgaagtcaatcagctccaagtagaaggtggtgtgtggcatagtgtgtggcatttttgtgaagatttgtgtactttctgtccggtctgccttcctcctgcctgtgataaccccataagtataatgttgcttgcacctgggcagggatcaccagatgggtatagttattagatgacttgggagaaaaagtacagcttgtttattttcttctctgcttaacagttagcatttgggggaggactcaaactcaactttgagagaactgatttcttgtttcattttatttcaacaagttgctttatttctaaaaatacatcaatggccaaactcaagttgcagaaaagcaccctccttccagcagccccacctagccacacgtgcacgtgcacacacaagtccagccctgctctgtcttcccaccagggcagcttcccaaaatgccactaggaatttcaccagttcccttcacagaagacatttgttcgtggcaagtgctatgatttcgaggtcaatgtcttttttatttttgtgttcatattgagaaaataatgctggccaggcacagtggctcacacctgtaatctcagcacactggaaggccaaggcgggaggatcgcttgagaccaggagttctagaccagcctgggaaacatagaccccatctctataaataaaagaatgtagaccaaaaaaatccccccaaaatgcaaaaatctgttatgtttctaatagctccagaaatttccattcctatatttttggtaacttttcccatttgccattgctcttggaaggggaaacaagtagtttttattgagaagtaccattgaaaacattcttcttattggggaagaagatcaaataattgctctgtcacctttctaatctaagtttttataaattaccccaaatttgattgagggagggcccttgggtttgacatgagaacatccttatggaaaaataatgcttgatgttttaccaaaatcacttttatttgaatggggagagacactttaagaattaccttcataatttgcctttgtgattttctgtgaagcatgccagccatggtttggcagtgtgaacacttgtaaactctacaaaaattggtgaatataccaagtttgggacagagggccctcctagtttttccaacattttcttgagtttaatggaaaactacttatactgtaatattcttagaccttatacctttcataaacatattgcttctggcatttaatctattatttaattttatttctatattacaattaggcatatttcaggtttgtcttcaatttcctgaaaagtgattttcttttcagccaaaatgaagtcatatacaatgagtcttggatctaggaatcaaaaaataccagttctttctgccagcatgcaggctcagtgagggcaggaacctcatcctgtctgctgttatttccctggagcctagaaaaatacctgacacaattactcagaaaagtatttatttaatgaatgcctgagtgaactgcctgttatgacttttctgaggtcatttgttatttttttaggttcactttgtatgttaaactaagtattactacgttatgaactacagcagatgctgaagagtaggacttaggatgtgcttgaatgacccacgaagagataaatgagatttaagaactaaaggggtggtggtgaggaatattccctggacaggccaaacccactaaagtattcccaccatttgcatctccccaggagcactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaagtaagtaacctgtgcttactaaatttgtctagaaggcacccacccacactggtatttttatgaagataatcaagaatcagtaataaggacttcataatcatcaaagagcaccacttgtgtatggccgtgagatagactctacacagtcccatcatttcttcaaaactctttctgcaagaccaggacatccacaactttaatcactttgtatgaaatgctattttaatgaattttatttttgctcagattgtgacataagtgttccaggtttgtgactcagagttaccagtagcctgagtcttttcctcttcttgaagctattggtatcatctatcaaaataaagataagtatagaacaaatacataaaaatataaattagatgaaggtggaaatattttttaatattgattttgagtttctgctgtatgttgtaaccattgaaaaatcaacacattttgttatttaataattgtttatcaatatttcttactccattaagctctgcccaagggtataagcttatatattacacattctcttgtactttgcaaaattggtttaatttcacaacacatcagagatttatctcaagttaaacagaagaaacaaaaatgcacaaagaaaagacatttctgcaattctgctttcgtgcttctttttctccaaagcaattttgcaccccaggggttatttaacaatatctgaaaacatttttggtagtcacaactagggggatgctggtgggtagaggcagggaggctgctaaacgtcctacaaatacataggacagccccccacaacaaagaattatctggttccaagtagcagtagagccactgtttagaaatcctgctctaaagaaacaggagaacaatacctatgcaaatgagacttttaattcagtgccttaaaataatctcaggtttgcatacatttttaaaaataaatataacagctgactttctcttgatattttcatttagaacgcatataattgggataagggataatcccttgtatccctattaatgttaaaactcagtttatcctaaagggctgcaggagagtgatattccttcatgagcctctgtttcttcctgtattctctgaaattgatactctttaatgtgtatgtttctgactctgtttatctatattgcccttaatttttaaatttagatcaagttgccttttatataaaaaaggttctccatccttgttaagcagagtgaaacaagttggtgacctttcccctgtccaacagacctcctgagacaattcttttctggagagagggtccagaagcaatcgtagaaacagtgcggctaaagttaaggatattgatgagaaatttaaagagaatctgcttctttatcttttactcacagattcactaatccagatagaaatcactcttcaaggagtgaaataatatcaaagaaggatttagtttctggatttagttgaaatttgggaatgcatatgccttgaataccaaaaacctaaaatatgatttagcaaggtagtgtgagtcgaaacgttatatgctctcatgagctatagattcttatgacccaataaagggaaagaactaggattatctgttttccattccccttaagcagagaatatttaagtatgtgtagttgcccccaaatgcaatgtatttttttctttattttttaaataatttaactttttgaaataatatgtgcatatgatgcataattcaaaatctctgaaagggtaaccatgtgaaatcatatttggccctgtcacccagccatcccattaacccctttcctggaggcaaccatttttaccagtttctggggtttcctactagaggtattcagtgcacagaaacatatctattatgtgtgtgttccatacatacatatttatgtaaaattttttctactgttctgtatcttggtttttaaacgtaatatatctttgagctaatttcatttaagcaagcatagagctcccccatatcccgtgacagccccaccgaggacctcctggggctccctagtcaaacaggttaatgagtctaatggctcaaggcttctgagaacctccctggtgcatgaggaccttgagggtgaggataagggctgccttgcttttagcttccttaaatacattgtttttggtaccagaacgagtggctggggtgacagttctgagagggattgggcgccccctagtgtttccactccacccctgaaaaatgtactttattatgtgtatttctattcccgttaagctatagttttcataataatgtaagggtgatatcttctgatggccgtgcacagtggggaaatatgtctcagagaagagcccccacatgatgggggttccctatgggggcaagagaaaccaagatgagtcgtcctgttcttcaagtttggcccttgttctttcctttgccaccctgatttccaccctcacctaccagtgcacctgatttctgactctcgccaccaagaaatctgtgccatggaggatatgaaattgtgtctttacaaacttatttaggatccaaagctcagccttcaaagtttgatattatcagcattaataatattttaagatctaaagtaacttaatagttcacaatagcttaaaagaaaaactcatccacctgcattaaatctgctcccaggaagtatagagaacctgcttccttggatttaaaactaaggttaaacaggacttcattgttcccttaaaatttaagccttttctaacaaatttggaaaatatttaactcttgaaaatgttaaactctttggttgcagaatgattactccattataaaggatagatcttttttagagtagaaaataggaaatgataggaacaaagttggcatgtcaacataatgaacaaatttaacatctgcatattcctaaagtacttttctaaattacttgtttcttgagattagtcaacattaagaaaaaaattgttttacaacaataattttgccccattgttttttaaattagattgtgtatagttacctaaattgtggtttcattttactcaccagaccatattaagctgtggaaccattagaaattggtgacagacaacactgataagtgggcattggcagcactaatagttatttgttgctgactatgcaacaaaaaagctaaaagctataaaacataatgcctgaatttttcatttgttctatagtagctatctaaaaaaatccaagtttgcttatgtaatattatttggtgtggtcatttgcccaaaatgaaataagctgtaagtttgtataatataaaataatctacctaaatcgtacaagtaagagtgctgttgtttcttaagctgatgtattacttaagcaaatgttttttctcattgtattgctggagttattccttctggaaggggttcctaattgacttttttaaaactctgaaagttttgttgattggttaacacacaaaaaaatgtagagacgagtgtcagctgaaatgtttatccaggactctgttagtattgctgggggatagttttcacctggaggtgaaaacgcattcagttaataatggaaggtccaactcttcatgtacagtgcctagtaatctgtcctcacattacactgaagaagtatttctgcctccagagaaagttgaaggacaatgaacacttgagcaatatgctttcaaaaagcaaaaatattttcttggaaaagctagcctatctgtaaatagtttgtgttcactaagaagaccatttctttggtagcacaagggagcaggccatttgctgaaacactggactgtggaatcacttttacccggacattgggttttctgatatccttttaaaaacattttaacaaataatatactcctttgtgtttacatgcaaaactcaaagaaggttacctatcctccctgactttaacctacctctctgggtattcagaaaccagacagagattttattttttggaatattatccatgataagagataaccactgtgacactttactaatcccagagatctgaggttatttctactagctggttttattttatttttatttatttatttttgtattgagacagagtctcagtctgttgcccaggctggagtgcagtggcacaatcttggctcactacaacctccaccacccaggttcaagtgattctcctgcctcagcctcctgagtagctgggattacaggcttgcacctctacgcctgactaatttttgtattattagtagagacagggtttcaccatgttggccaggctggtctcaaactcatgacctcaggttatccgcccgcctcggccccccaaagtgctgggattacagacatgagccaccatgcccagcctctactagctgattttaaatcagagtaagataagtgatgcttatttatatgtaccttttctccaattccttctcactaacactgagaggaacagagaattgtcagaatagtaactattgtgataatggtatgcagcactcattcagcacttactgttacctggcactgtgtcagggactagacattattttatttatccttctagtatttcccccattttcagaagggaaccagaggcttaagattacacagctagtaggcaatagagctggaattgagcccctatctgactctagctagtgcccttaattactattgtaaatggctaggaatcgtatttgtgaggatttggtaggtttggaaaaggactttcttaatcctgatattcagaattgtcctaaaacttacataaaagcctaacctagcttttactgtattgttaggcttcagggatactatgtgacctgaaatatatacacatttttaacaagtggtccatgttttaacaggtttggccagcccttcttacaagcttcctttgtgccaaattttcattgttttttgaaatcaccaaaccatgttactaatgttgtgttttggtttgttttacagtgatccttttctgtatggctgccctaatatttccaataggattttacatcaatgaagtcggaggtcaaccttataaattacccaacaacacagtagttgggtcatcatatgtactttttgtcttatcaattttctttacaatagtaggacttctatttgctggcaaagtttgtttaccaggctgatgaatgtctaaattgcttgactcttattattttttattttattttatttttttatttttggagggtggagaggacaaaggcgaggcatctgagcaggcctctcatgggaagatgctcagatgaaactgatgctgagaaggaaaaaaaaatgctttggtttgttctcactatgcactttggatttaaaaaaaaaaaaaaaaaggagagccttttccataaccaaatacagacaatattgactaaatctcctgagcatattcaggcagtcaggtctgcactgtgatagcaacctagagaaggagaatgctttataccgaaaagcatgtggccctttgtgactctgttattccgtttttaatgtctaatgattcattagaggaaaaaaaaaagtctaagtatttatgtgtcatggtggaccagagggatgcaagagaagttcatgtggggctggcctcacctcctaagaaattagtgttcacaacttccttgtaatagtatgagcctttggcaccagaatggattgccgttgcattactgcaccaagaagccaatagatcaaaacttgtttgctaaaatgtatgtaaaaattctgaaattccctctctctgtgtacaaaaaaaaaaaaaaatcaaacactaagacacatgttttgggtgggtgggtgggggaaatcttccttatatttatataaatatatataatatatatattttgctgatgcagtatacagtgtgtatatatgtgtgtgtgtgtgtgtgtgtatgtgtgtgtaaatttatatacacacacatgcaaacagttcctggaagagaattctgaatgctttgctagcaaaacactgtggtgtgcaaacctagaacccaatagaaaaaaaagccatttatctgaaggctgcatagtggagagagtcttcagtttacctcattctttgtagcagcccttgattttaacaggtttttgtaataggtacagataatcccatacctttctaggtgcgattttaagttaagctaaaaattatttgtagggttaatttatttgtatatgatagtagaaggtaagatcatgtcaaaccttataatttggggaatctgacactatttaaattattggcaactgttgtctgttgtacagagattctttttctactggctcagtctgttacattaataatgcattttatatgttcaggcacactttacataaatacaaagttcgctagtaaatatctggctattttggctatttacaacactaatttcattatttttatctgtaagcattattaatacatctttaccaaaacctgagcaatacaatattttctttatatgttatatgcctttgtttgctaaaagctaatatttttgcatttactttaaagggctgtactaaacccacagctttaagttcttccctaaaagaagcattgcagctaacccttgaactcacagttttaaaatacagtatttctcttctccacatctccatgccttcgcatcaatgcttgtttttcctggtgaacactatagataatctcctgtttgaaatgtgggacagggtgtttcatggcagtggagctaagtttctcctctttatagtgaactggtgacccaaatgtccctgtcatttatagtgaactgatgacccaaatgactccctgtcagtagagtcccatgtggcccatgcttcacacaagcagaaatgaacgcactgtttttaaggctagattatcagttctagaatgattacttcaaagatgggagctacctcctcagatattcacactatgaaatggaggtgcttgatgtgtttcacactggcttgtttgacagtcttctatcttactgttaattcagcagtattttattgtgaaagaaaaccccagtgtttgagctcactcaggaattggggagagagatggaccaccactgtggtgcatttcttaagtgttctgggagaatgtcatacttttccttcccagagtaaaagaaacctttgggagatcctgagggagactgtttctccccaagtatgatgatgtctagtcaagtctaagaataccactggacatgttctatggacatttgggattgcagttgctattctgatttgattggtcctcagtcaaatggatcactttgaaggaaagctttggttgtcaccgttatataccactgagataaagtgttagcaaagtatggttcaaattaacttatgacatgaccaagagcttttctcttccaaaagatgaattgtattgtaaatagtttctcaaaatatttttaactggatcatgagcatggggagagaaagtttctcagctgctaagaatttccccactgtttacttctttcacttatggtggtattgcatttaagattacaaaatttaaggttttatttgtatctattacccaaaccattaaattgtctttaatttcattgttgtcttggaggtccagtgcatacagggctgatgggggaaaactccctctagccagtcagcactctaacccaggattaaaccatcccatcaagtagtatgtgaagtcaagtcttcgtactcttgcagaccagacattgaaatggattcattcatatagatttctataaatcctataagtgaaaagatagacaactgtccgcagttgcttttaaaaaaggtcactataataagtactatatagtacagtattaatttatagcaggaaatcgtatcttgtaaactgtatataaaacactgttttatggtgcaatcatttgtcaaacttttgtctgtttcattgtttttagagtgtgtgcattcttctcatacctaagaatatcactgtaaaatctgctgaaaactatttttaggttttatttgcacaagactgaattagtttgacatttttggaagctcctattgaacatacccaaacatctgtaaacatgaaaaatcttcaatttattaaaagcaaacatttcagtatgattctttccaaaggtaatccatgttctatgttgttaatgtgtgtatgtaatttttctgactcttccacctcttataaacctattttctgtttcatttgttttgtttttgaaggatggctcttttttctttttaatgttctagatgaccaaaacactattggtttttacccttttgcctaaagctttgatatccccacttgatgttctgtgaattcactgtttaatctattaagtgaaataataaatagtcctggtgacaaacaatctgttgatttagaggaaaggccctgaaaaatacagtattggaaactaactttgcatatgctgttagctattattttgcatcatgggcttcatgggaagaacatgttgcatttattttgtctttattaaaagactactagccacaagttactctgattatagtaactgttttatcaacccacttcatctttaaaaaattaaatttacattcacaattcaaaacagtaagctgtctttcagaaaatttttgaaggataaaaacatgaaggaaaaaagtggcccgtgtaggtaggattccctacacaggacttttagttgtatcacctcaagagattttgaagtttgtgatcaaggtctgtatattatcccaaactttattaagaattgttttctaattggttataacatttttcaattaatagtttcaaaacaaattgttaatacaactgtataaaatgaacataattttcctcacttgtatttttgttattgagcaagtttatcaaaataaattgtctactaaagaaactaaaaaggcttctattactttgaaataagcttcatttaaaaaattgatttcttatggaggtttcacatattcacaagtgccacttccatgcctcttgggttggttttttgttgttggcattggggggtgagggcggtctttccctatcttcttccactcccactctttgctcaccgctagagaagagatgccattaatattccaggacgtggattaggccatgattacccaagagtcactcagcaataaaagaccacatacatgtggctttcccttctgcgtcatgcttccatgagctaggagagagaaaccaagccaaagccctcaagccaactatctttctattctttcttccttgcacatagacccaagtccatctttgcttcagtcttctgtttctactttactccaggccaaaagatcttagcttttaaaatcttaaagtatgggctggaggagcaaatacagaggcctttaggccctgtcacagcttaactatagctctctctgggggtgtcaagattagcccaaccgaataataataataaaatatttacagtttgctgctgattcttccttgtgtggccttttgaggagcctcctggggaattggaggattaagacatggtaagatttagatgttcttgggttctaagattaaggggtttccttggaggtgagacttgaagtactatgtctgggaaagttccaggcaaactaggataagttggtcaccctaccctatcttcacatcatctaaatcttctcctgatttgtaacacagattagaggtttttggggggttattttctataaacattaatgaataggtcaattggaaattgtaatggtagatttatgctgagctgctatggtggaggggacactttttctatttggtaataccttaggaaaaggtaacacagtggctttgaaaacaacatgggttcaaaaatactttattttgacttattcttctatcatctctattctagccactatgagaagattataggaaaaacaccaagactagaggactctgggttccttttatgcaaagtcaactcttctgggtcacagttacccagcaacaaaaataaaggtagttatttataaatggtattaaagatagaaagcacaatgtatattttttaagagttttggttcttttcccaggagaagaaaacactgtgggttggtattttcaagcacattcaagggttttacaaatcagccccagttccagtcacacacaatctaagaccacccaagataacatttcaagaagagatttttcacaagactataaaatttcagtgctggatgaaatgtcaaagagcatgtccagtgttttcactttccaggtgaggaaatcgaggcctcagacttttccaaagtcactcaactagatatcagcagagcactcgtctttgacatgtgggccttggacttaagaccaacattcatattctctagccattgaaccagtcttccttcaactggtctccattcactctgatccatccaaatcaattctgccaagatactcataacacaaaagaaagcatattatttccatgttcacatttctgtcattcccattgtctacagaatgaaatccaaactcctttagcatagctttgacaagctttcgtgatctggcttcaagctctctgttcagtcatttcccacctctctctctcgtcacttcttactgacaaccagcctgttctccattctagattcactacaacctgctccctgccccggttgtgtctgtaccacctcctctcagttttaaagtcctcccatatttgaaatatatctaatcttttgtgctttgtgtctctttttcttatgcttctgtaacagaacttgctaaacaggcatagactgcctggattaaatctcaattccaccattccagttgtgtgacccttagtaaatcatgtaacttacgtgagccttggttttttcatctgtagaatgggactaataatattacccacttaatggggctattgttggtttaaaggagataaagttccaagcacatagtaagcattcaaatgttagttgctgatattgtcattagtaagtgcttttgtataactatataaactcttgaatgcaaagagtatggcttcctcattgtgtactcactagaaacctggcacagtgctttacacactgaattatgaaaattaaagttggggctaggtgataaagaaaaattatgaaaccatatttcctggagatttgaaagacagagtcatcaatctgccaggtttgtttcagtgaacttcctcctgaaggcagaggcttgcctaaatcagcctttataaggatggttactttattaataagtatttggctatataatatatcagttccattgatctccttagaatttccccatggactccagatcctttactactgaactcacagggctgtaacactgttactgtacagagaggaccaggacgatgccagcaccccgtttatcctgagtgaactctccggaggcctcttcaagcttgtgggttctctgctgtcttgaagccatccatccatttgataggttttgcaaagacttggtcctgccaagatggttttaatcatttctgctaaaaggaatggactcgaggatttgatctcattttagatgcagttgtcctcacttggccattttacagcactttagtaaatatggccagtgtatttggtcactattaaatcaatccccattcattatctgtcagggcaactcagtgaactaaatactatgttctgacctctggcactctttctcatgttgtttaaatatttaatattgtctaaggcaattcaagtattttcttaaataaaaaatatgaaaactcactcttttccattcctttgttttctatgacaaatgcaaagaagttgaagaaccaaaatcctttccattttccataataaattgctctttaaaaactgacatatctaagaaggcttttgactacctcatcttctaaatgttttactaagataggtagtaagcagcaaaatgaacttatttggtgcagtcccacccttacatgcaccactccaatactttacctaatttctgccttcagggttatcagtaactttttcctgccttatgtgctattgtggagaaagaaattatgaccttgagccgggacacaaattttctttttacaataacatgtatctgtagatttttttaaaaaacacaaaaataatataggaaacaaaaagttccctcctccacaatccaccttccagagataaccattgttaacagtttattgggtattttaacagacattttactgatcagtttaacaaaagcaagatattatctatacctgccactgctttttttttttgagacagggtcttgctctgtcacccagactggagtaagtgcaatggcacaatcctcagcctcaaattcctgggctcaagcgattcacccacctcagcctcccaagtagctgggactacaggtgcatgccaccacggcctgctaattaaaaaaaaaatttttttttatagagatgggggtctcagtatgttgaccagggtcgtctcccagtctcctcctgccttggcctcccaaagtgctgggagccaccatgcatgccctgtggctttcttttttgacttaatttgtgatgtagatttttctgtgtcagtaaatatagagcttcctcattttaaatgcatagtattccatttgatacatatcaaatatgtgtcttcccattttgatgtacatgaggttgcttccagatttttgttattgcagataatgctgctgtgaacttaggccttggataacaaaaacttctcaaatgtcataataacctgacattctaactgaagcgtatcaactattaaaggaattcctattttcaaaagcactgtggttaaataatagtggcattctctacgtttagagaaggaaactaacagtaaattcatgtgttatgtgctttcccatatgtcatcttaatcctctacctgtgaagtacagggtggtgttttatagactacaaaaccaaggatcaaaaggctgaacaccttactccaggttctgtaactagcaactggtgaatctgggtttcacagccaggctccctgacttcagatctaggactcctgctgtcctgcattgccagtgtggctgatctaaagggaataaaaataacttgtcccgcttgcatgattccttggctcaaacatgagcagctaaatctatggtttgcttcttctggatgtggaatgcaaacaaccataaaaggtggtccctatttagaaacactttccactttgttgagagaaaaaaaaaaaaaagtaagaaaaacctcccacttattaagttgtttgtgtcaaatcttccatcattcccctctcattgttgagctttctctttgtaatcattgttcactggtttttgggtttggtttggtttttggctgctcactgcagcctcgacctcctgggccaccatcttcccacctcagcttcccaagtagctgggaccacaggcacgcaccaccatttctggctaattttaaaattttttgtagagatggggtctcactttgttgcccagactggtcctgaactcctggcctcaagcagtcctccagcctcgacctccaaagtgctgggattacaggcatgagccaccatgccccagcctgttggtattttatagtgccgacttccttgatggatgaagctagatgagggcattgattttactggggccctttcaggattccagcacccagggaaattttcccaaaccagctgctcctcacccctactcccaaagcacttaaaactcaactggatcccttctactggactggtaggaatttactggttattggagtactctaagttgtgcagaggttcgtggttcaaacatttggaagtccctcaccccaccccaccccccgccaccacccactagttgatcatctgtctacatgttactgctgagacatcagttgtcccaggctaaatgaggcagtagttttactgtgttcgtctcacacttggggaatgacaaactttggtgagctaggaactcctgtgtctggactcttccctgaatgcaccaaggacccactttctcttagatattgccatcttaccaaagtattgccaccaaacatggaacaagtttctactccctctgatttttagatctctgattttttttttaatctgtctgggagaatatcatctcccctttggctttcctgagaggcatgtttgcctaataccatggtccctttggtttcaaaaaaaaaggctctttctttttggaaaatcgttcctttcctaccttcgggccatgtggtttcatggggccaatttcacgttctggcttcagagctcgacagaagccagacttggacagagtcatggtgacagattcagaaattagcatggcatgtgactagcctgggactttgctggaatagagttgctaagttgtaaggaaaagtttggtactgctggcagccacacctgaagagcctcctgatcaagccatcctagaagaaaggaagctgagaaaggaagacagttctgttaacatcactttagcttttggatcaagtcatccctgaagccagaactatctctggattcttgtgttatttaagcaaataaattcttttttttccttaaaccagtttgagttgggtttctatctcttttaactgaaataagctttacactcccactttcctcatgacattaaacacattcctcacctcccctgctttggcatgtcactttaatcttttcgttagcttaggcttttacaaaagacagaaaaaacagttacttcaggctactgcttctcaacacaacccaaagcacctgctcctggtttgaaatgggggaaagaaagaaaacaaaacaaattaatatctgaaatatatatcccaccatattcctggatgggaccacgctagagctcctaaataaaagaccagagatgagctgaccctgatccatttccaagagcctaaggtaggagaaatgtctgttgtgctctgatgctttccatggatgccatcatgatctgcatcccgaagggagccaagaaagatggtacccacacagctttcctcttgatgagtcatacagtctgaaagccttactctgctttatccacctggcagagatctattgagaatgtgtgttgtgtaggctcaagtacaagaaagcaggaacaaagagtttccagtgttggactttacttctatgcacagtgttgaaaacccatgtatgcaggaagcaaagaaaggtgtgagggtggtagacgacctgcttggggctcccgtgcctaaaaaaaaaaaaatgttgtcaaaattagccagccccttccacccaaaatttccatcaagatgggcacaaggaccctcatctcttgttcaccgagtagccattggttgctcacagccacttatgaccttcttacctctttctgatcttcctcattttctgccttattggtgctggccacataacaaatgctgtggtcttatacatggtgctctcaaccccagtgaccagtggttgataaggagtttctattttgagcacgttggttgtttctgacctggcctataggcatggctgctggggtcaacatctgaagggtgttccctaccatatgatgactaccacaagtggcatatgttctttatttttgagacagggtcttgctctgtagcccaggctggagtgcagtggtgcgatcatagctcgctgtagccttgaactcttgggctcaagcgatcctcccacctcagccttccaagtagctgggactacaagcacaagccactgtacctgactaatttttattttattttatttttgtagagacagagtctcactgtgttgcccaagctgatctcaaattcctggcctcaagcagtcctcccgcctcagcctcccaaagtgctgggattacagacatgagccaccacccaacctcatgttctaactgataaaacttacaagtttataaaacttataaaattctcagaaagtgaaaactgatttgagaaatgacctggatatgaaaaactaagtacagatcctttagcgacttacaagttggttgactttggtgacatcactttgtctctcttgaccactataaaagaagggtttggagagattcccagctatgggccaaggactagttacatcataatcacctggggccattgttaaaaagtcacattcccacaccttttcacagttctgaatcaatctcctgaatgggaatgttttcctagcaaacaatccaggtgattctcatgggcatccgggcttaggaaccactgtggcagatgatctcttctgatgcgaagaggtcactgagcttggctgtgttagccaggtttaggtggggctggaccgggtagggataggggactgtctgacctctcccagggactgtgttcagggaacccaagggaatctgagaaggaagagaaagttaccacctttgacacatgtggcagagttctctggaacctctcctctgttcctaccacaggaaggccacaggcacgcaccagggctgtactggcctaaaccatagttctgtgctgactgagaggttctgaaattagaaaagaggtctaaatcctgcttccaggtttttgtgaggtggagaaaagcagagtgacctgggagaagtggttatcaacaacacagctggtgacttcttccctggggtgaggaaggttttccctttccctgccccgagctgcagtggtgcagtctgttaccttggagaccagctaacacattcccgcagggcaagcttcgctgctgagttgcttggaggagcttggagaaaccagaagtgagatccaggagaagtaaggccctggagtgccaggagcccttctcccaaagatggagaaataaatgaagaaatacaggtgagggtgagcatcacaagggttgacaggggtggtgagagggtgtcggggaggccagatactaagctctggactgagtgagaagatcgagggagcttggggtgtgaagtgtccactccctacatgccgagcattgggctaaatgctggggtgccagtagacaaggaagtcatggagccggtctaggagacaggccatgacaactccatatgaccaagtgaaggggcagcgacaggaggacttccacaggaggagtggtttcctccctggggacagcaaatgggattcaggaaagactcctattattattattattattttcacccaataatcaaggttccctctctcccttggaccaaaatgccatctgccatggcctggttgttcttttcctctcctgcaatcacctcccagggtaattcagctcacctttgcctaaactctggacctgctctgagtgcatttattcaacaaatgttttttgagcagctactgtgttctaaactctattttatgcaaaaatgtcctagctgtgaacattactaagtcccggcccaaatggatctacttctagtatgtttatgtaggaggggtgcgcgggggttcagacagtaaataactaaatatatagaaaatttaaaacaagtagataagcaaatatatagaatgtatttactgttaagtaaataagtgaatatatatagtgaaacatgctgtggggaaagacaaagccaggtggaggaggtgctgtttgagttaaggtactcacagaagacctctctaataagatttcatttgagcaaaggcctgagggaaagggctgcgtcctgttcatgtctatctccccagcacccgttctctctggcacgcagtgagtgctctataaatgttcatgaaacacatgattgtttttgtgtcatatgctgaagtgcttgaagatgcagcccatattttatggtattctacatttgtatagtacttcatatttcacaaagcagttctactttctcaatttcatttgatcctcttgataacagcattgaagtaggcaggtcagttactgttatccccattccattctaaagatgaagaaaccaaaggttcagcacttttttgtttgttcgtttgtttgagacagagtctcactccaacacccaggctggagtgcagcgatgcgatcacagctcaccgcagcctcaaactcctgggctcaagtgacctgcccaccccatcctccctagtagctgggactacaggtgcgcactgccatgcccagctaatttttgtattttttttttttttatatagagacggggtctcgttatgttggctaggctactctcaaactcctggctcaagcaatctccctgcctcagcctcccaatgtgctgggattgcaggcatgagccattgcacccggccccgtgctttttctggagcactattttgttttgtttattttatgcagttcaaccccttctccatcagcctgcaccagtcaccccagaatctagccatgcagtcctctgaattcattaagagctgttaatcactggctggaaagagggaagtgagacactatggggcggccagtgttcatgaggcatttctatttcaacagtctctgccattagagtctcccaggaaagcttgctgaagtaaagccagttttttttttttttttaaagcattgccacattatcctggtgcttcccagaaaacaaagcatcctctgaataaaagattaaagacttgaaagagaaaagcaagttgccaaaccattattaggctgtttaatttaatgatttcacaagaacacacactctaagttgcaactttattcagagtctctcacttgctgtgtcttagctggtatttttttggttgcaaataacagaaagctaaaggagctagctgaagcaaaaaaaaaaggtagagaattctaagaaacagggtatctcatggaacccaagaacagaaaggtctcacacgtgcctgggatatataattagaaattcaagaaccaaggcaggttgggcgtggtggctcaacacctgtaatcccagcactttgggaggccaaggcaagtggatcacctgaggtcaagagtttgagaccggcctggccaacatggtgaaaccccgtctctacaaaaaatacaaaaattagctgggcatggtggtgggcgcctcttaatcccagctatgtgggaggctaaggcaggagaatcacttgaacctgggaggtggagattgcagtgagccaagatcatgccactgcactccagcctgggtgacaagagcaagactccgtctcaaaaaaaaaaaaaaaaaaccaagggagtctttcaacctcctgccccttcaccttcccttctcaaaatatttatcgagtgtctgccagtccctgctcttacataacttacagtgtaaggggacagacacacaaattttaaaaaatccctctaatgaatgtatcgttccaaattaagatacctgccctaaaagagcatggttctatgaaagtctgtataaaacaaaggaaactgaaatataatgggatgctggagatttcctgaaggaagtgatattcaagctgaaatgtcaagatgattagggtaggggagaagaagaacgttccagagcaaagacagcagcacatgaaaagtccctgtggttaaaggaactatagagaattccagaaactggaaagggaggcccttgtggaacacagaggagagcagtggtgaagtgggaaatctagaggggtaggtgggagcagccagaccttgagagtcctcagatgccatctgaaggatctcagtcttcatcctagaaatagagaaggctttgatcagttttaagcaggagggagaaaagggggtgtaacattggatttgggtgtggatttttgtttattttttagaaacagaatctccctctattgcccaggattgagtgcagtggcatgatcatagctcactgcagccttgaactcctgggctcaagcgatcctcctgcctcagcctcccaagtagatgggactacaggcacataccaccacacctggctaatttatctttattatgtttatagagatggggtctcgctggtttgccaaggctggtcttgaactcctggcctcaagtgacctcctgcctcagcctgcctcccaaagtgctgggattataggtgtgagctaccatgcctggccccttgattactttctattatccttttagttctttccacactttccacaatttgtaattattttatttagttttttaatatcagtctccccctctagaatataagcgctgggaggacaaggacaaagtctatcttagtggtttacaactagggacaattctgctgtccatgagacattaagcaatgtctagagacatttctggttgtcacattgggaaaaagtgaggagggatgctactgatatctaataggtagaggccaggatgctgctaaacatcctgcaatgcataggacggcccccacagcaaagaatgatccggtccaagagtcaaagtgttgaagttgagaaagctttatcttgttcaccattgtatcctcagcaccaagcacaatgcctgatacctggcaggtgttcaataagtatttactgaatgaattaattaaagaagagttggctgagcacagtggctcactcttataatcccatgacttagggaggctgaggaggatctcttgaggccaggagttcgaggctgccataagttatgttagcaccacattacttcagctttggtgacagagcaagaccttgtcaataaaattttaaaaatggccgggcgtggtgactcacatctctaatcccagcctaggtgggaggatcacttgagccctagagttcgagaccatccaaagcaacatagtgagaccccgtctctacagtaaacagaaagattagctgggcatagtggcttgtgcctgtagtcccagctacttgggagattgaggtgggaggattgcttgagcctgggaggtcaaggctacagtgagccatgattgggccactgtactccagcctgggcaactaagtgagaccctatctcaaaaaaaaattaaacatgtagaaaaagaagcattgtgctgaatatagataccccccaaaactattgtctgtatgccacatttatcctgttttctggtattcttttcttctttaggaaaataagcattgggtgttttgcaatggctacacaaactagtcatgtcttccatggtcaagaaaatatgtttctggaaaaccattggtaagcatagttctctgattttttttttttttttttttgaggcagattctcgcactgtctcccaggctggagtgcagtggcacaatctaggctcactgcaagctctgccctccgggttcatgccattcccctgcctcagcctcccgagtagctgggactacaggtgcccaccatcatacccagctgattttgtgtatttttagtagagacagggtttcaccgtgttaaccaggatggtctcgatcccctgacctcatgatccgcccgtctcggcctcccaaagtgctgggattacaagcgtgagccaccgtgcctgggctagttctctgattttgcaaacgaaaacagcaacagcattttgctcatgggagctgagggtgagactgggtaaatggtcattgaatcttcttatagccacctgagggctttagttatctaaataataaaatatctcatggaactggagtccacattttatcaggactctgcaggaatccttctcagttactgcacagaaaaatgtttctagaatccttgtagggactagggcaaagagaggaggcactgggggtatcaaacctatgcccagtgctggggcattgatcaaattactttatgttttgtagcattaggagaaacactggcagagattcaaagaagccactaaagcagaagaatatgaatggacttgggcaaaattcggacaatggattattggttacacatgttaaccagacacaggacttactggtaaagaccatggcactttaactgggtcgtgatactacaaatcattcagagaatgcacagtgtgttaaattctggggatttcttccttctcataggattctaggactgaaaaaggagtaattaagcatttatctctaatcctctgccttcagaaatgactgaagaatctctatactgtttatatagaaattgtttagcctatttggccatgtcactaaatattcaggagcatgtgaagactctgatcatgttatcaaggcctgaagtcttaagcatttgattctaaaattccccttcctgagatttgctttgcttttgagattccctgaaatcgagattcagaaatccatttcaggaagtgctgttggacaaatggggtatgataggagaataaacctctgaccagactacgattttaggctgaccttcaatgtgccttcccaagagggtgagtggattgtctagaactcagaattcattctaccagggacacagtggcaatcagtggttgccatgttcaagcaaggctagtgcacaaccatgtacctaacccacactagagtttaaatatgatacctttgaaatgatagtcaaaaacaatacaggtataatgctggcaattaaacaatcagaaaaatactcatgatttacttaggttctggcacttacaggaaagcaagcttaattaaaggagacgaggaaaggttgatagagttttgagattctgaagaagtcttgtaatgggttcagatgttgatgacatgcatctttcctctaattttatatgaaaatgcatgacttcccaggtgtagacaggatcattcttatatttatcagccacagctggggcctcctttgccttgcagatgaacctgaaggaaagagggaaaggattgctccaacacgaagatcttaccattctctatgcaaatgaactagtagagttacataattagcatggcctaaagtcaaaatccataatgtgtttaatagtgtatcttcaagtatgaataatacaaaatctgtgtcctaaaacatgacatcatttgaaaagcaacacagatggaagaaaggtgaattattaagtccaccatgctcaccaggcacggtcgttcacatctgtaatctcagcactttgggaggcctagatgagaggatcgcttgagtcccgaagtttgaggccagcctgggcaacatggtgaaaccctgtttccacaaaaaaaaaaaaaaaaaaaaaaaaaaatacacaaattagtgaggtgtggtggcacgtgcctatagtcccagctaattgggaggtctaggaaggaggatcacttgagcctgggaagctgaggctgcagtaagctgagattgtggcactgcactccagcatgggcaataaaatgagaccctgtctcaaaagaaaaaaaaaaaagtaccatgctcggtgtttccaaccagggggagggttgagtctgaaaggtgagaagagtgacatctagtgtccatgtgatagagagctgtatttccctagatatgcgacagggacctatgattttaggtgcctttcaagggcaggacatttgttagcacagaatcacataatgagaaagtaatcttgcccgtcagtcctctcactccttcatggaggtggtcacagtttggtgctagtttagagggacaacatagtgccatggttagaagcatgacttgagctttacagcctgggtttgaattccacatctgccactttctagctggatgaccttggactgattacctaaattatctgtacctcagttccctggtcagcaagatggggttatcataatggaacccactttgtaaaattaaatgagttaacgtacggaaagtgcttaacatgtaataagtgctatctaagtatttgcagtaattatgagagtgtttttcacacttcttcaacacttgctaatttccctttgagacagacagcccagcaggcctcaggcacagaacttaagtcaaggtcgcttgagcccagaacttcgaagctgcagtgagctatgatcacaccgctgcactccagcctgggtgacagagtgaggccctgtctctaacacggacaaaccagggggctgggtacagcagcccatgcctgtaatcccagcactttgggaggccaaggctggtggatcacttgaggtcaggagtttgagaccagcctggccaaaatgccaaaaccctgtctctactaaaaatacaaaaattagccaagcgtggtggtgcatgcctgtaatcccagctactcgggaggcagaggcaggagaatcacttgaacctgggaggcagaggttgcagtgagccaagatcattccactgcactctagccttggtgacaagagcgaaactccgtctcaaaaaaaaaaaaagatagggtcagtctgagttggcgcccgttgggtatctgtgtgaagggaacctcttccttccctctctttccacttcacggtttgactctggcttttgtcttgcagaggctgcaggggagtgagacccagtcttcagattgggaggactctgaagactggctttcggctcacagtttaaaatgtcagaaactcaccttggctgacctgataagccagggcacagaagtgctgtaagtctgaagctgttccccgcaccccccacagctgcagtgacacatgcaaccccctgggcccgagagatcccctcataaggctttgcttcttcagggaggagggcaccaatgtcgtgcagaaaatatgtttctccacccagatcatccgccattttgagtcaaagctttctgagtaagtatgtttctcactgtcctcccaacaccacagaactcaagaattatgtcatttcagtccgggcatggtggcttatacctgtaatcccagtactttgggaggccgaggcaggtggatcacttgaggtcaagagtttgaaaccaggctggccaacatggtgaaatcctgtctctactaaaaatatttttttaaaaaattagccagtcctggtggtgcatgcctgtatcccagctaccctgtagtctgaggcaggagaatcgcttgaactcgggaggtggaggttccagtgagctaagaacacaccattgcactccagcctgggcaacaagagcataactctgtctcaaaaaaaaaaaaaagaaaggaaaaagaaaaagaaagaattatgtcatttcagtagcctggaagtaactttgttcaaacagcaatctctgtgggaccttgggcaatagagtgggaccctgtctcaaaaaaaaaaaaaaaaaaaaggaaaaactaccactcagggagatgagcatgtctcttcccacttctagccccaatttccccttttctcaaatagaaaggttggaccagatcagtgtctctcagccttttcaaatccatagtctagggccaggcatggtggtccatgcctataatcctagcgctttgagagaccaaggtgggaggatcacttgagcccagaagttcgaggctgcagtgagctatgatcacaccactgcactctagcctgggcaacaaaataagaccctatctctaaaaaaatataaaatgaaatccatagtcccttggatgacacagcttcatctggtgtttaatggttaagagtaatgactttcaatgtcaaattgattgcgttcataactttgcaaatatatgccaaaaacatgcatgcatccccactcctaaaccagattttgatagcacatgtgtattagtccattttcatgctgctgataaagacatacccgagactgggcaatttacagaagaaagaggtttaatggactcacagttccacatggctggggaggcctcacattcatggcagaagatgaaggaagagcaaagggacatcttacaaggcagccaggaaagagagaatgagaatcaagagaaaggggtttccccttataaaaccatcactctcaagccagttaaccaaaagtcaattgctgaatggccattcatggaatgaccagttgctcaaatttctcaaaaccatttaactgtagaatttatagtaacttttattaggttggaagcttaaacaggttttaaagaattctgcaatgtcttggtttatcagttttaattgtgaatccagtattttaaggaatgttcaagtctatttagctaactggtcatttggcaaattgattttcagaggactggctttcagtaaattgacttttagcaaattgacttggatagaatcctgttgttaccttcatgttggagatggtgaaactggggctcagaaaggttaccacacctgtccaaggtcacacagctagtagatggcagagctgtatctcaaacacaaacatattttattataaagctcatcttcagctgggcacaagtggctcacacctgtaatcactttgggaggtcaaggcaggaggatcgcttgagttcaggagttcaagaccagcctgggaaaaatgatgaaaccccaactctacaaaaaatataaaaattagccaggtgtggtggtgtgcatctatagttccagctacttaaaggctgaggtgagaggatcacctgagccaagggaggttgaagctgcagtgagccatgatcgtaccactgcactccagcctgggcaacagagtgagaccctgtctcaaataaaaagaagaagaagataaaaataaagctcatcttcttagctctattcataactcatgtatcccttatgactctatctaccacccactgccccatgatctcatttccaaagaccttttttgtccctctctaggcccccaaatctcacctgcccccagtaagaacaagtcaattaaattaaagtgacctagtccttaccttgtgcatatgatatatgctagtcttcaaccagtcattgcaagccaggcatgcaataaggcaagttcaagaaggtcccccagctacttttcagaaactaggttttttgttaatcaatccagtagaaacgattgcttaactgcctctgttgtgcctttatgatcagtttccaggagactaggaacaattccttctgagaagacacagatttgagcaagtgcaagggtggtcttccaactttctcgtaagaacaccctcccccaccctccacagacctgccctcaccgggcagagtgagcacagagtgagtgagctatgtggagaaaggagacgaggttacatgagcaggttgaagtctgggagggcctgattccaccccttgatccaccaaaccgttgtcatttatcctgtgcactgtgtcaccaatagagcagcacctatacactcgatccctttcacaatctccttatacctagtgccctggcaaacaagtatcttcagttttgtctttcctcgattgtgcccaggcttgagtgcagtggaacaatcataactccatgcagccttgaactcctgggctcaagtgatcctcccacctcagcctcctgagtagctgggactacaggcatgcaccaccatacccagcaaatttttttattttttgtagagacagggtttcactaggttgcttaagctggtcttgaactcctggcctcaagtgatcctcccacgtcaggctcctgagtagccacgactacaggcgtgcactacagtgcacctaaaaggttcaccaccttcttccaagaacctatgcacattaaaaaaaaaaacaattattcatacctgccttttgtgtatgtaagtggctgttgctcagtgatgacgctggccttgggtgatgagtctttctgatgtcttgacagcactattgaagtctatcaagagagaattcagtggctcacagaaaacagcaagaaggtaacgggcatagatttcattctttgccccctttcactcattccatttgtatttgttagaaccctttcagttgcaaatgtagacctccaatataaattgcttaagctaaaaaaaggcatttactaacctaagtaaatgaaaaccccagccacagctggatccaggtgctcagatgatgtcacctctatgcctgtgggctctgctttcctgagttggttttattctcaggacatctctcttcaggcataggaaggtggtgatcagcagctccagtaaaaaggaacttcacttcctgttccctgcacaacttccaaatcctgggactgactctcattgaccaatttacaccaatcatcatagccaaggagatgaaatatactatcactatttgactaggcctggaactagtgctgacttctggggcaaaaataaaataaaataaaagacaggggggaaggggaaagagactggattagccccccagccctcatggactgaaaaagagagacagatggttgcatgtggaaggccagagcactgttaccagaagggggaatgggtgctgggcaggtgagaatgcagatgtgcactgggcatttgactttagacccgcaatgagatttagaagactaaggctgatcatctggatatcacttttcttaaaagtttgattaagggctgggcatggtggctcaggcctgtaatcccagcacattgagaggcctaggtaggtggatcacctgaggttgggagttcaagagcagcctggccaacatggtgaaacctcatctctactaaaaatacaaaaaattacctgggcgtggtcgtgcaagcctgcaatcccagctatgcaggaggctgaggcaggaaaatcgcttgaactcaggaggtggagtttgcagtgagccgagatcacgccattgcactctagcctgggagacacagtgagactccctctcaaaacaaacaaacgaaaagaaaacccacaaaagtttgattaagggctaggcatagtggtgcacacctgtagtcccagctacttgagaggctgaggcagaaggatttcttgagcccaggagcctcaaggctgcagtgagctatgattttgccactgcactccagcctgggcaacagagcaagacttgtcttttaaaaaaaaaaaattttttttaattaaatgtttttctcagaacccaagggtagaagagtgaccatgggcaaatgaacactttgatttgctttcttgtttgttttagcttaattgccatcaactggcacttttctggcttcccgtttgcttccaccttaggcacaatcttcagctcttgccttaaaccctgggaaaagcagatgctaaaagtcatgctccctactcccagtccccacctctacccagatgcagatgctaaaagtcatgctccctactcccaatccccacctctacccaagactagtgggtaacaacatagtgctaagcctgcctgtcccgccaattccaggctgtggtcttcacctcagatccagaacctccttcacttgcttggacgagttgagtcaacagatgcttgtctgcagctatagctggacccctctggttgcccatggtaacaggcagagagaccccacgggaatgaaatcctcccatactccataggcatccacgtagggcatgctgctctcaccccccgacctccactaccccatcctcgcacctttgtcaaagtgggcggggattgatagccccttcatcctgccacccctttctgacggagctacagagaaaccatggaagagcccagggaaacgatcacctgtaaatcagcttaccaggtccctgggtgttgaggcaggcagcctgaggtgatggccagataatcgctggtccctgttcctgttctgctctgtcactaaggccctagaaagtggcctcgcttctctggatctgtgtctgcagaggataaaaggagaagttataaactagtggcatgcaggccaaatctggcccacagccattctgtttaggctccctaattttaactatttttcaaattagttgccaagattttttaaatcctggtatttcacttttatgtctgctatcagacttctcttgaaaaatgagaatatctggtattaccaggctccaattgcctcttatgtacttgtccagttatttctatggaataaatgtctagaacttcaatggctaggtttagggaatgaatgttttcaattccaaaagctgtaaagccctcatggcagcttgtttttaatttaaaaaaatagaactggctctagatttcaacttcttgcctccagattggcaataccctagaatatttgggtcatgaattcaacaaacatgtattgagtgattattgtatatcaggcactgttctaggattgagactaccaacatgaccagtacttgctgaaggaatggttcgctgtcgggggaaaaaacatgaccaatactaaggtcctgccttcatggagcttacgtgctgtaaaaagaaacaaagctgagtaagggaacagagggtggaacaggactatttaaatggaatggttgaggccgggcgtggtggtgcacacctgtaatcccagcactttgggaggccgaggcagatggatcacttgaggtcagtagtttgagaccagcctggccaaaatgctgaaaccccgtctctactaaaaacacaaaaattagccaggcgtggtgatgggcgcctgtaatcccagctactagagaggctgaagcagaagaattgcttgaacccaggaggcagaggttgcagtgagccgagatcgtgccactgcactccagtctgggagacagagtgagactccctctcaaaaataaaataaaaaataaataaatggaatggttgaagatactcactctgaagaggaggcatttgaacaggcacctaaagaaagtgtgggggtaagccctaccaatatcttggggagaatgttccaagcagaggagacagcaagtccaaaagtcttgaggcaggaacgagcttggtatgttccagaagcagcacatgggccagtgcagcaagcacagagtgagctatgtggagaaaggagatgagcttagatgagcaggttgaagtccgggagggcctgattccaaagctgagggctttaataaagcaggggagtgacctgatccaacaagtttcaaaagaatcacgctggctgctgcataacttgactgcacagggggtaaaagtggaaacaggacaaccgctctgggcgagaacgatggaggcttggactcaagctctagggtcgacagaatgagatatggtagattcaatgcatggctggaaggtaggaccagcagaacttgctgatggattggataggtctggggccagagtgcctgggccagtgttgaatggcatttactaagatggggaaggctgagggagaaacagtcttgaagaaaactgagaggtcttgttttggacatgtgaggcctgagggacttagcagacatccagacagagaagcggagcaggatgttgggtgcacaggtctgaagttccaagagaaatctgtttgaagatggacctcagataatcatttagcattcagatggtattcaaagtcatgacactcagatcacttagagagtgatcaaagaacagtggttctccaccaggggtgattttgccccacgggaacatttagcaatgtctggagacattttaggttgtcattgctgaaggagaggggttgttacctacatctagtttatcagcagccagggatgctgctcaccatcctgaaatgcacaggacagctccctacaacagataattatccagcccaaatgtcaatagtgccaaatgccaatagtgccaaatgtcaatagtgccaaagttggcaaaccctggggtagataaagaagagagtggccaggcacgatggctcatggctgcaatctcagcactttgggaggctgaggctgaaggatctcttgaggccaggagttcaagaccagcctgggcaatgcagtaagaccctatctctacaaaaaattttaaaaaaaaatagccaggtgtggtggcacacacctatagtcccagctacttaggagattgaggcaggaggatcacttgagcccaggagttccaggctgcagtgagctatgattgtgccactgtgcacatggaagctcttgttaaaataaagactctaattaggtaagcctggagtgggacctgagactctgcatttctaacaagctgggggatggtgatgctgtcagcccatgacccacaccttcagaagcaagttcctagggcacgccagtattgtgactttggaacaaggaggaggggctctctaggaaaggaaattaagaaaatatggccagtgaagagaggggaaagtgggagaatatagtgtcctggaagacatgtgtactaagtgttttaatttgttaaattcttgacacagtcaaactgtgctatatgctactcagagttcgggaaagtcaagaatttggatttaacccttgggcttggcaagacaaaggtcattgatcaccttgacatgtgtggtttcagaggaataggaaggtgagaacctaacttgaatgggtccccgggaggtaaggatgtgtggctaagatggagagcagaaaaattaaacagcaggaggaagaggtagcatactgagagatctatatcttttttaagatgggcaatattataacctgtttgtatggtgatggaaattgtacaatcaataggaatggatgatccaggagaagggatgattacagaagcagagttcctatttagcaagagaagatccagtaatgcaagtcaaatgttagcctagaccattgctggttggccttagatgcattttaactggaaaaaggtgaagtatgtagggctatgggctggtaggtcagtagactctgcatggaaagattttttttaattctctccaatttgtttttgttttctcagcaaaattggaggcaaaatcacttgctgggagagtacagaaagggagtgctggaggtgtgagaggagatgtaaaatactctctgagagcagaagagtgaattcaacaggaaaattagatatccagtaaagtaggatttaaggaaaaacaccgaatggaacctactgcccctagagaactatcaatttcatgtgaatgaaagttccaatccacaatgcagctataacaagatgaacatttatgtgcagagtcaaacagcattgacaagtaatacagacagtccttgacttagaatggttcaacttaggatttttccacttatgatgggtttatcaggacgtggccccatcataagtcaaggagtaataactgtagagtaataccgtttagaaacataattagaaatttggatgtggtggcacatggttgcttgagcccaggagttcgagatcaacctggacaatatagcaatatgccatctcaaaaagaagaaacaagaaacataattagcaactcagagataccattgcagctggcgaacctaacacatctgtctttgattgatagagtaggcaaaaaataaataaggatatagagaaattaaatcagataagctaatataaatagccatcaaattttatatcttcaaacaaagggtgcttttctatagtctccagattttctacaatgaccatgtattacttcataagattagacaataaatataaggggaaaaaacttataaagaagaggctgccacaaaataagagcagatcatgcccagagctgaagtcatgacattgggttttgcttttcccttataaaatgaggtttccatctgctgctgcttgttaggggtgaggaaagtgtttgcatcactgcgtggcacagagcagctcagtgtaggagacacacagacttgcactggctgtttccaaatgccctctttggttttaggcatttggcctcatcaaaggggccagagtcagcatcctcatagatgtgtcagccatcagcagtggccctcagaaagaagagttccaaaaggacctcatggtaagtctgtctggcacagagaaacacctggaaccacccactacccccagcctttccttcctgagcttgctgacgagcttgtttatagcaaatgcaagatagggtgtcttataaagaacagttcacacttaattagcacctgtggttagagaactatgttgaattctacaaaacccaaccacagagtcattttcagttgtagtgtgaacttccagtattctcaccacgacagtacctgccaactagtctttgactcaagagctcccacgtttccctggaaggaagatgtgaagtctcctgcatagcatagcacagggcttctggccttttctggatggaagagctattctggtttctttggagttatggttcccattggatactcaccagctctagtttgagagaagtgaacaggctggtgttgctcattgctccatccccaactcacatccatagcagagaagctaagaactagagtcagatggctggagtcaaatcccagccacctccaccaattccaggccatgtgactgcgttaactaatctctctgtgccttacttacctcctctgtaaaatggggatgataaccctaagtggctacctagggttgccataagggtaaaaggagcttgtgcaagtgaagtgcttagtgagaagtctggcctagagaaaaagcctctgcagcgtgatgtgatgtggacaggctattttcttacgggtaccatggcagcaatagccagttgtattttgtacaggtcctgcagagccgttatgaggctcagtgtggggctgtcctccagacttgtcccctgttcctggtctcagtggatgtcaggggacaggtgtcagagcaggctcccccttcatgacaagtcctcaggacggagtttccaaagatcccccaggtggagtggtctactattagccagggcagagctcatgggggtggcatacaggtggaatttctagctggccaggaagaagagggagaagttatggatactctccagctcacatgccttagagagaaacctctgtcctccctctctgggtgccacaggtaagtgccaagggtccagcaatagcacattctgagatggcagcccagatgctcatcccacccacaggaggcccggcaggcaggaagcaaatgtcggcttggggctggctgctaagcccagcctcgagcagccctattcagtacagctcacacccagcccagaggggccagcaaaggccagagaggcaaagccaggctcccgattcccctggctgtgggagccagtgatgtccttttgtccaacagagcctcatcgatgagcagctgagccacaaggagaagctgtttgtcctgtcctttggcaccaatgccgggtccctctggccagaccccatggaagtcagcgcctccacgtgagtggctttcctacctgacggtgatgttcacttgttcattttcctccctaaccagcagagtctttattgaataattcaactgcaaaccccaggaccctactagataagtgagtacaaagagacaactcacaaaagcagaaacaatttttggaaagatgtctaccctcgtgagcggttcataaactgacagataaggtgaccacaagacactatttttatccagcaaagtagcaaagatagttttattattgtgaaaataacacatgcatgttttttaaaaattccaacagtatgaaaggatgataaataatagcaaatgagtctccctcttttttttttcaagacaggatctcattgtgtctcccagcttagagtgcagtggcacaatcatagctcattgcagctttgacatcctgggcttaagcaatcctcccacctcagcctcctgagtagttggggctacaggcatgtgccaccacaccctgctaagtttttatttatttatttagacagggtctctgttgcctaggctggagtacagtggtatgatctcggctcaatgcaacctccaccccacgggttcaggtgattctcatgcctcagcctcctgagtagctgagattataggcatgcactaccacgcccagctaatttttgtattttttggtagagacagggtttcaccatgttggccaagctggtctcgaactcctgacctcaagtgatccacccacctcagcctcccaaagtgttgggattacaggcacgagccaccacacccagtcagtttgtttatttttgtaaagatgggatctcgctatgttgtccaggctggtcctgaccttctggcctcaagtgctcttccagtcttggcctcccaaagtgctgggactacgggtatgagacactgtgcctggcccaaaacagttccttatatccacttccacaaataatctttgcacacacatgcatctgtgtgtttaccttctaattttcacataaataggacctacataacactgctctgtaccttggctttctagctggtcttgaatttctttctctgtcagtgcatacaaatctacctcatttgttttaatggctacatagaattctactgcagggatgtcttttagctgggggtttctagcctggggtttttttgagggacaggagggaggtatgtaagaatttctacttatccagtgagtagaaatttattttccgtgaagggaatgtcctcgattgcccaccatgtattggttaccatactaggtactttgcatagatgattgtatttagtatataatagccacctcatggaataggattattatcctcattttgctgatgaggaaatgcagactcaggttagggaagatgcccaaagtggtagagccacgatgggattccagatcccaggaaaaggcacatgctttggccagggccagttgctcatgcctgtaatcccaggacttcgggaggccaaggtgggaggatcgcttgagcccagaagtttgagaccagcctgggcaacccagtgagaccccatctctacaaaaaatttaaaaattagcccagtgtgatggcatgtgcctatagtcccagctactcgggaggctaaggtgggaggtttgattgaacctgagagggaggtcaaggctgcagtgagctatggttgtgctactgtacttcagcctgggtgacagagagagaccctgtctccaaaagtaaaaagttaaaaaaaaaagcatgtgcttagatttctaggacggaggccccctcaccagcactagctgtaaagaggggcccttccagatagagaaatgcccacttctggcagctctggctttgaatcccaaccccaacagtcactactgggtggtcttgacaagtcccttataactctctcatttgcagaacaaggccaatcctacccactcttcacaggactgttatgaagatgaaatgaaaacaaagtacctggctagtgccaggtactcaatgaacaagaacgttttttactctgatttccactttaggtggagcagtgacacctgggttgttatggatggcagccaaaagttctgcatcttcaggaactcctggaattctcttgtcataaccctatgtcatatctttaccatgtgtactattgtttattttattttttatttatttggtttttttgtctttttgtttgtttgtttttgagatggagtcttactctgtcacccaggctggagtgcagtggtgtgatcttggctcaccacaacatctgcttcctgggttcaagcaatcctcctgcctcagcctcccaaatagctgagattacaggtgtgctccacaatgcctggctaattttctttttttttttttttttttttttttttttttttgtatttttagtagagacaaggtttcaccatgttgaccaggctggtcttggactcctgacctcaagtgatccgccctccttggcctcccaaagtgctgggattacaggcatgagccactgtgcccagcctaccatgtgtactattgttgatttttctttacttcaattctatttattattgaaagaaacttttttgtttgtttgttgttttttgtttttttgagacaaggtcttgctctgtcacccaggccggagttcagtggtacaatcatagcttactgccatcttaatctcctgagctcaaatgatcctccagcctcagcctccccagtagcagggactacaagggtgtgcccagctgatttttttaatttttccttttttgtggagatggggtctggctatgttgaccagactggttttgaattcctggcctcaagtggtcctcccgcctcagcctcccaaagtgctgggattgccggcatgagccactgctcctggcctgaaggaaactttctatcaataccataactgagaagctcatatcacttgcatgattatacttctataatcatgcaattatatttctataattagaaagcaaccatatatctttctttaatggctttgagaaaaaaaaaaaagaaagcagccatataaataaatacgatgagagcaaaacagtggttttaaattccagcttaaatctattggctagagaaggtgctagacctgggacttattctcgctgttcaaaagggagacttgacagttatgatcatgaaagatgaacttattagcaccacactgagattttctctttcagatttttgattttttgaagtagaaagaacagacctctttcactagtgctatgcaaaattttagccaagaaagaatcaagttatttttcttctcaccagttgtgtgtaccccaacccatgtgggacatagccacacagccataaagctttctcttagagccttcttagggtcgcggaattaactccatgcctcctgttgagggctggctcccaagagagtgggtatgggtaagaaggaactcagccccagaccctcacatagcacaatttctaaaagctcagatcttagagtcagacctggtttgaaatctcagttttaacagttgcttacagtatcaccctgggcaagtcctaactcagtttcctcatctacaaaatgggaataaaggtaccacctcaacaagttatcattaggtttaaatgagctaatatttgtcctgggcctggtacctaatactacaggccagctgcaggggctcacacctgtaatcccagctgtctgggaggctagggagggggacctcttgaggccaagagttcaagaccaacctgggcaacacagtgagacccctatctctctatttttttttttttttttgagatagagtctcactctgttgcccaggctggagtgcagtggcagtggcacaatctcagctcactgcaaccttccgcctctggagttcaagcagttctcctgctcagcctcccaagtagctgggattacaggcatgtaccaccatacctggctaatttttttgtatttttagtagagatggggttcaccattttggccaggctggtcttgaattcctgacctcaagtgatccacccacctcggcccccaaaagtgctgggattacaggcatgaaccaccatgcccggccctctacagaaaatataaaaattagccgggcaggatgccacatacctgcagtctcagctacgtgggaggctgaggcagcaggatcgcttgggcccaggagttcgaggttacagtgagctatgattgcaccactgcacttcagcctgggtaacacagcaagcccttatctctaaaaagaaattaaaatgaaattcaatacaaacagtcttataattaggttgctgttgttgtctcctcccagcctccaggaacttaagctctgggtaaagacgctgcagcctgatggaggcagcaacctgctacaagctctgaagaagatcttcactctcaagggactggattccctggtggccatcatgagaagctggtaggtcttctttcctaagcaggtgacatactacatgaaaaggactgaaaaaccaaaccactttttgagaaaagattggcttgtcacagtggctcatgcctgtaatcccagcactttgggaggccgagacaggaggattgctcgaagccaggagtttgtgaccagtctgggcaacacagtgagaccctatctcttaaaaaaaaaaaagacaaaaattagctggtcatggttgtgtgcacctgtagtcccagctacttgggaggctgaggcaggaggattgattaagcccaggagtttaaggctgcagtaagctatgattgttccactgccctgtaacctgggcaacagagtgagacccagggaaggaaggaaggaaggaaggaaggaaggaaggaaggaaggaaggaaggaaggaaggaaggaaggaaggaaggaaggaaggaaggaaggaaaggaaaggaaaggaagggaggagggggtggggagggagggagggagggagagagagagagagagaggagagagagagagagataagaaagaagaaagagaaaagatcatcaaccatggctcttcacacatacatgagggagggatggcagtcacaggcagaaagaaagagagaaagaaagaaagaaacaagaaaaaaagaaaggaaggaaagaaaggagagagaaataaaaaggaagaaagaaagaaacaaagaatgaaagaaggaaagaaaagagaaaggaaagaaggaagagaaggaaggaaagagaaaggaaagaaggaaagatggaagagagagaaagaaaaagaaaagaagaaggaaggaaagaaggaagagagaaaaaagagaaaggaaggaaagatggaagagagagaaagaaaaaagaaaaggaaggaaagaaggaagagagaaaaaagaggaaggaaagaaggaagagagagaaaaacaaaggaaaaaggaaagagagaggaagagagagagaggagaaggaaggaaagaaggaagagagagaaagaaaagaaagagaaggaaagagagaaaagatcatcaacaatgactcttcacacacacacgagggaaggactacagtcacaggccacccacccatctgcagaggaggcagagggcagacaggcctgcagtccacctagccctgcatgccacataggtgacctgtgacacaggtggccagttaagaatgggtagatgttccttgggaattaccgttttgctctggaatgttctcaaagtggtctgacctgggatttccacttctcttctgccttctccacagcccagatcagccttctgaaatcctgtctgactacatccagcagtccaccatgggaagagacctcatcatccacttcatcacctacagatgcgatgatcagatgccccctgtgagtgcccgagattctctgaggtgccccttggctttggtggtagtgagctgggctggcctttgaggcctcatgcttggacaggcccccgagctgtggaccagaatgcacctgtccctgtgcctggttctccctttggtaaaatgggaagctttggataattgggaggttcagtcaaggagaaggcttactggagtattggtgttgccctagtgaggcctgaccctggcctcatccctgcaggctgtcctgaagaaccttgcagaagctgttaggggctactaccactgctacagcccaaagatggaggtaagcccttctgtcaacacatggcccctcttcttctctccttgtctgcctccaaggttgtacccaggagatctgggccaggaccatactatatacttgtttctccttttctccttgtccccacctgtattcaatgaggttacacaggtaaaatcaggttagaatgaatatgtgggaagaccagggacaacctgaagtcacaagagatgctttgatcagcctgtatgatgcattgattgaatgcgtgggagcccagaggccttttaaagccctgcctgcagaatcctcagtctcactccagttgccgttaatataggccccagcctagctctgctcccaccaaagcactaagtctgaattgcctcgattttctctcctagatcaactcctgctactgcagggaacccactgcagagcgaaatgagcaatccattctgtaccgatccatccattactgtccttgtcccagttaataactagacatcagccaccctgtgttcacaagggaggcaacgattagcaaacatgtgtgtagatccatttggaagattaagaatgcaatcatctggttgctcccaggctgtgtcttgcctaccattaataaccatgagtaaatgagtgtttgcatctcacaagtgaattcaaaggtcacaaggtccctgcttttcatagcagggagccaagctcaggcagcactctatcttgatacctcatcatctagactctctctgcaggtgactcagactacagaggttagaaaggtaaagtaaatgactgaaactgactggtttaagaaatattttatcttaaaacctgtggcttgaccaggcatggtggctcatgcctgtaatcctagtgctttggaaggccgagacaggaagatcatttgaggccacgagtttgagactagcctaggcaatatagtgacagcccatctctacaaaaaatttaaaaattagtctggtgtggtagcacatggctatagtcacagctactcaggaggctgacacaggaggatcacttgagctcaggagtttgaggctgcagtgaccaatgattgcaccactgcactctagcctgagtgacagagcaagaccctttctctaaaaataataacaaaataaataaattattattattattatagccatcctagtgcgtgtaaagtgtttctttacacttttacagttagaaaactcttcaattgttttaaaacacagcaggtcaggatgggtgcagtggctcacacctgtaatcccagcactttgggaggccgaggcgggcagatcacaaggtcaggagattgagaccatcctggctaacacggtgaaaccccgtctctactaaaaataacaaaaaattagccgggcgtggtggcgggcgcctgtagtcccagctactggggaggctgaggcaggagaatggcgtgaacccaggaggcggagcttgccgtgagccgatattgtgccactgcactccagcctgggtgacagagcgagactccatcaaaacaaacaaacaaacaaaacacaacaggccaattgcacaaacggagcacagcatgtctgcaggctctgtctggcacatgggtcccagtgtataaggcctggtggagagagtctgaccctctgcctgggcattggcctggctgcttgccccttcctgggttgacccctgcaggtagtcaagtgattccggatgtctgattgctcttgccaccctcagcactacaccagccgggacatggatgagctcctggcagaaattcagaaggcccagagcctcctcagccacgtgcaagccctgcagcacagcagcccctgtgaggcgctcacctgcaccatggaggaggtaggtggtgcgagtgtcaattctggggccttctcccagcagcactcagctggcctcgttcccctttctcacctgttcatagggggcacagctgccagtgcctgtcacttcctaaaatcgaaacaaggcaaggcccaccctccattgcaccccagagctctgagttgggtgggctgggtgggcccaccatggtaccggaaagattctggtggatttactaactgtaaaatttatttcagagaaagaccagcaggctcctgccaccctctctatcctgtcactgtcccctcccttacccccagtttggagaatgatgaaaacctcaaccacccagaataggctgcctttaagagagtcattctcacctcagccatggcttacacctgaaatcccagtgctttgggaggccaaggccagagaatcgcttgagtccaggcattcaagaccagcctgagcaacatggcaaaacaccgtctctacaaaagattaaaaaattagccaggcacgatggcatgtgcctgtagttccagctactcaggaggctgaggtgggaggatgattgaacctgggagattgaggctgcagtgagccatgatggcactgctgtgctccagcctgggcaacagagcgaggccctgtctcaaaaaagaattttaaaaatatacaaatacaataataacaattagtattagaattataatagttcttggccaggtgtgatggctcatgcctgtaatcccaacactttgtgaggctgaggcaggtggatcgcttgaggtgaggagttcaagaccagcctggccaacatggtgaaacctcgtctctactaaaaatacaaaacttagcgaggcatggtggcaggcacctgtaatcccagctacatgggaggctgattcaggagaatctcttgaacccaggaggcagaggttgcagtgagcctagatagtcccactgcactccatcttgggtaacagaacaagactcccaaaaaaaaaaaaaaattataatagttctcatttattaagtcctcattatgagataggcacaatgttcaattatttaaatgctttatcttaacactctgaggtaagtatgttattactttttatagatgaggaaaccaaagttaagaggttacataacttgcctgagattgcaaagatagaaatagattgagtttggattgaacccaggtctaaggcccaaaaccttgccaagagtttcccaaaatgaagtgcatgtactacttgtagtttgcaagatgattttaggtggtgcatggattaaattattttttaaatggtatctatttaaaactagctcattatggtcatcatagatcttctttctaaaattgtgaaagggattgaatttttaaaattaaagaaaattaataactaaaaagcattaatgttacatattgattcttaaaatattaataataatacagtagcactcagatatagcaaaattcatgaaggcagtgctcaaatctctgaagtttgggacttgctgttctatttttacttacacattcgctatgtaatttaatctctcagcgcctcagttctttactttgtcaatgtggccacagggtggccaggtgggagctcactaagtgatttgctgcaggagtttttaggggtgacctgtcaccttggagtccatggtgctgatcttcatggtaaggttagggaaggagccaggagcatgggccactgtgagagcgagttgctgggtactccttcctcttcccctggaaattccagaaatctgcagagaaggggaggggatgatggaagggaaaggcaaaactgcctttaatctaccagggagtgtttaagaagctccacttgcattgactgggtggagggtgaagactgaggacttttcagctctaaaatatgattatgtaatgagggctttctcatttaacttagatttccacagagattacaaatgggccactcataagcctcttgcctaaacccccaaagcatgacgctcctctcaccattgagtttccaaacttggacaagacttctgcagagtggcttaaggtcaatggtctgaaaggtaaatctccaaagagggcagaacccaggaaacaggtgactgactaaaaggcttgaatccggccgggcacagtggctcacacctgcaatcccagcactttgggaggccaagaaggaaggatcagttgaggccagggatatgagaccaacctaggcaacatagcaagaccccatctctataaaaaataaaattagctgggtgtggtggcatgcacctgcagtcccagctactcaggtaggctgaggcaggagaataccttgagcccaggagtttgaggatgcagtgagttatgattgtgccactgcactctagcctgggtgacagagcaaaaccctgtctcaaaaaaataaaaggcttgaaccctttggagcttctcaggcagtgcctccaacctcacacttttttttcagccaagaaattaagtctatatcaggtcctggcacccaatgcattctctcctgtggaggaatttgtacctattctccagaaaacagtatcatcgaccatccatgaggtaattcagattcataattctctccagtcctccacaggagagctcccttgtggcttttcctaccttcataaatgttctggcagtaagaatcaccagggattcaggcttcccacccaggaccctagaatgcacatcaaatccactgtagctgttggttttcaaagatctgaaaattgaacttgggagatgaggcaagagggataaatcaggtaccacggtcacctcctccatgaaggttttctcctcccaactcagacaggacagacttgctttctttatgtcctcgctgtacctaatgcagacttctgcaattgctcccataaaggattaatgcatgaatttttacatatttaaatccccatcaagtatgaagtataaagagggcaaactcttctctaactctctatcctccatgtttagtataagtaggaaatcaatgcatgtttactggatggctgagaaggtagttggaagaaaggatggcaagaagaaggaaaagaatgatggatggatggatggatggatggatggatggataggtaaatggatgaatggatggatgagtggatggatagatagatggatggatagatggatgggtgggggggtgggtgggtggatgaatggatggatggatggatgagtggatggatggatggatgggtggatggatggatggatggatggatggatgcatggatggatggatgcatggatgggtgaatggatagaaatctgaacaggtggaagggtaaaagggaaaatggaaggatagatgacaaaatggaataaaggacaagtgaaagaatgaaagtagaaattaaagtaaggatggatggatggaggagtgaaaggatggagaaatggaaggaaggaataataggtgaatagaaagatggcagaaagatggaagactgaaaggaagagagaagagtaagggacatgtaggtctagcagtgcatggatgaatgactagatggatggagtgatagatggatatgttcacttggtggaggatgaaaaaacaggatgaacaagttggattttcaaagcatctgtaaaggcctgtctaggttcccaaacctaagaagctatggccagtatattttaaggtctccaactgtgctctctattactaaaaccctccaaccatatcttcatgactctgatgttcagaaaagcctctcgggaaaacagcctgagaggcttgctgtcaggtatcgtccattcaggggatcactctctctaaggctctctacttccagttccagacaaggcaatgacctggtggtggtggtggtattggggtgtgtgtgtggtggagatgtgggagggagttcgatccgacctcaaatgtgttcagagtccacttcactctcctgcacctgatttggagaaccagtgcccaaattaaactacatgtacttctgttcgcctgctcaccctcctgcccatgcctgagtatagaaggcaatgatacaatttgaatggcacgacgggacagtgaagaacattcatgtggacccacccttcctctataagtaccaggtcagtgatgggttcaatcagtcagaaaatggggtgcagaaagtggggacgggaggaaggttccctgggctatgaagtcaccaagccattgactcaactccctcttgtaaagagggactgtgtgctccacctacaggcctcctgaagctttggccatctcctccccaagcagggacctcaatgcctttaaaaaaaaaaaaggcttctaatcctctggggaaagatctgcttccttccccatttgatgcaatgaaataccgtgtgactcttcccttcctgttcttgtggtgaatttgttcatgatttagtggaatgattatactgcctggattcccagggacttgacacaccattccctgaagcccacccaggtacacgtacttcccctcaggccccttggttgctcagcctttgagcagccgctcactgtggcccacacttctgcagcaacagctcagcagagctatgcggatgtatgagaggcggattgagtggctctccctggccagcagaagaatctggggcacagtctgtgaaaaaaggtacctttcttaagcagggttcttatccttcatgggtctggtgtgtgacgtgacatttatccgcctcatgaattccctgttggtagcatcagaagccatcacttagattagggattaggaatctctcagcagaacccccagaggaggaaaaagtcaccaacaccatcactgatgtcaataatgtcatcattgtgtcactgagcatttttgcaatcccagcacttggggaggccaaagcgggaggatcgcttgaggccaaaagtttgagaccagactgggcaacatagtgagaccctgtctctacaaaaaataaaataattagctgggcatggtggtgtacacctgtagtcccagccacttaggaggctgaggcaggggcaggcgggtcgcttgagtccaggggctcaaggctgcagtgggctatgatcgtgccactgtactcaagcgtgggcaacagagcaagtccctgtgtctaccacaaaaaaaaaaaaaaaaaaaaaaaaatcacacctcctccctggccagagcaaatgggtcatggatgaatagatcctcccacccagccagaggtgtgatgttctgattggccagggtcaaatgcccatccctggagcttggagtaggctcagcttcacacaactcaaattgactgatagaggcagaggtgtttcccaaaggaaaatcaggatgctgttgccagatgaggtaatggatgctgagttgggagaaacaatagttatctattatggccattattatgattccataccttgtttgatgaattaacatttacaaagtattatattttgtaatactatacatctattattattattattattattattattattattattattattattagagacagagtcttgctatgttgcccaggctggtctcaaactcttggcctcaagcgattctgctgcctcagcctcccatcatgttaggattgcaggcatgagccaccgcacctggccactatacatctattatgtaattttgttcttgaagcaaccctatgatgagtcttacaagtagtttatggttaaactacttaaacaaagatcagagaggttttgtgacttgcctaaggccacacagctggtaggaagcggaacttgaaccaaggtcttctgactgtaaatcccatagattttcttttgctatccatagctgtctcaaaatgagaatggggcagaaggtgggaatataagtttgaagttctaaaattagagaaagaacaaataaggctagagatcttaaaacagaaagagagcaaacaaaaagataaaaatattttccaagaggcccagatacacctaattccttatgttacttgctcacctggttttcgttttccctacgaagaccccaacctatggcgggcatagtggctcattcctgtatttccagtactttgagaggccaaggcaggaggatcacttgaggccaggagttcaaaaccagcctgagcaacatgggcagacctggtctctacaaaaaaaaaaaaaaaatttaaattagccaggcatggtgatgtgtgcctgtggtcccagcaacttgggaagctgaggcaggaggatctcttgagcccaggaggttgaggcttcagtgagccacgatcgcaccattgcactccagcctgggcaacagagagagaccgtctaaatatatatatatttgttgtgtgtgttttgttttgttttgttttgttttgttttgtttgagacggaatctcgctctgtcacccaggctagagtgcagtggcgcgatcttggctcactgcaagctctgcctcccgggttcatgccattctcctgcctcagcctcccaagtagctgggactacagtcgcccgccaccacgctcggctaattttttttatttttagtagagacagggtttcaccatgttagccaggatggtcccaatctcctgaccttgtgatccgcccgcctcggcctcccagagtgctgggattacaggcgtgagccaccgcgcccggccttatatatttgttcttgaagcaaccttatgatgagtcttacaagtagtttatagttaaactacttaaacaaagatcagagaggatttgtgacttgcctaaggcaatatacatatatattttttcatattctgacctataaaaatattgaatgctaattctttaaaataaatctgtgaaaatcattatatgaagcgcctaccacttaaaccatctccaccatgaggctttattccattaaagcacctcctgggagagaaggggggcttccatgacccccttaatctaccattgtaagcccacatccgttggcctcaaaccacagagaagattttggccagctatgaatttggcatgcaaaattcccctggaaaaaaactttaaatagtaaaatggaacaaaataaacattatctcagagattcggttctcctcttaaagctcgtgtttccttttagggtggttgtactgctcgatatctctgcgaccaattccatgtacattattcatatccagcactccctgcggctgctgctggaggagcagttatccaacaaggactgtttcaacctcatcgcgtatgtgtctcctggctcctgggggcaagggtgggtcgtgtgtgtttggatgccgtcattgggctgaggctttggacgttgctggacgatagatattgacgtcatggtcacccggcttcctaggatagccatcggtttatctgatttggatgatcttgtttggggcattgaataattaaatagttgcaggactgtcctactggggcgaaggtggtaagtgaccccataacacactgcttgatcaaccaggataaagtaattcagcccattggcccatttggcttccaagatgaaataggaagaagaggaaaggaaggaccccagccatgccctagtgtcagtcctcagcctgtctccagcaagccataccttttcaaacatttaggattccaattctgaatttaaattaaaactgtatatataaatttggccaggtgcagtggctcacgcctgtaatcccagcaccttgggaggccgagacaggaggatcgcttgcatccaggagtttgagaccagcctgggcaacatagtgagaccccatctgtgttttaataaataaataaaattatatgtatacatttaattatgtgtatatatatataaatggtatgcaatttttaaaactgtataatttagaattaaatacaacaaagatcagagaggttttgaagatttgaacttacttcaaaattatatatagttttaaaattatatatagtatatatagttttaaaatgttaatatagttttaaaattatattttatatataattaaatatagtacatatctagcatttttaatttaaaaactatatatatagtttgtttttggttttgtttttgttttgagatggagtctcgctctgttgccctgactggagtgcagtggcttgatctaagttcactgcagcctcctcctcccagattcaagcaattcttctgcctcagcctcccaagtagctgggtctacaggcacacaccaccacacctggctaatctttgtatttctagtagagatggggttcaccatgttggccaggctgatcttgaactcctaacctcaagtaatccgcctgcctcagcctcctaaagtgctgggattacaggcttgagccactgagctcagccataaaaactatatatatagttttttaaattgcatactattttaactaataagggaagacagagagaaaaggaacccacttaaagtgtaggtttttatacaacctcataccaaatagggcattttctaaacctattaagtcaacagttagtattagatattattctgtaccagagcccagtcattccttaataaactctatataaaaatatttatggtaacattatagataaggaattttatttatttatttacccattcattcattcagcaatgtttcattgacaatctgcatgaaccagtccctgtgccaggcactggggagatggacatgaagacacacaaaactcatcctcgaggaactcatggcctaacagtgggagacagggatgttaaggagtgctgttaagcgttttctatagaaatgagtagatagctaggtatgggactgcaaggtatcagtggcaggatcagtccattccacttgggtggagtaggctcaggacatcttcatggagcaagtgccccttttgctgagtcttgatgaataagtagatgtttgcctagcacctgggaatgatggggtcctagggagaaagggtgttccaggtagaggcaacagcatgagcagaggtgtgacgtatgctagaaccttagggaccatcaggtagttcagcatggatatggggctgagagggagagattgtgcatgacagaaataccaggtgatggaggattgatataggccatgctcacgagtttcctgtgctataggatataaaggcactggaggattgcaagcaaggtacaaatacaatcgggtttgcgtcttcaaatgctcaagcaatgctgtgaaggaggaactgaagggatgtaatactggagggaagagaccagtttgactattgcaattgcctgccctagtgttgagtgggcttgagccaaggcaatgtgaatggaagaaagagtgcgtggccagtaagaatgccatattaaagtcaaaaaataacaggtgctggcgaggtagcagagaaaaaggagcacttacacacttggtgggagtgtaaattagttcaaccattgtggaaagcagtgtgatgattcctcaaagacctaaaaacagaactaccattcaaagtagcaatcccatccctgggtacatacccaaaggaatataagtcattctgtcataaagacaaatgcatgtatatgtgcattgcagcactattcacaatagcaacagatggaatcaatgtaaatgcccagcagtggtagactggataaagaaaatgtggtatgcatataccacggaatactatgcagccataaaaaagaatgagatcatgttctttgcaggaacatggatggagctggaggccataatccttagcaaactaacacaggaatagaaaatcaaatacagcatgttctcacttataagtgggagctaaatgatgagaacacatggacacataaaggggaacaacacacactggagcctattggagggtgagggtgagagaaaggaaatcaggaaaaataactgatgggtactaggcttaatacctgggtgatgaaataatctatataacaaacccccatggcaggagtttacctatataacaaacctgcacacgtacccctgagcccaaaataaaagttaatcaagaaagaggtgcatggaggctgggtacagtggctcacgcttgtaatcccagcactttgagaggccgaggcgggcggatcacgaggtcaggagattgagaccatcctggctaacacggtgaaaccccatctctactaaaaatacaaaaaattagccaggcgtggtggtgggcacctgtagtcccagctattcgggaggctgaggtaggagaatggcatgaacctgggaggtggagcttgcagtgagccgagattgcgccactgcactccagcctgggcgacacagcgagactccatctcaaaaaaaaaaaaaaaaagaaagaaagaaagaaagaaagaggtgcatggaagagattttggggagttagaatctacagaatgtcatcactggctgtagggggtgaaagaatggtgaagagaagatgatgtcccaagaagaacagatctctgaagggaaagatggttttaaacatcccgagtctgagacactcaagagtttggagacattaagaggaggaggagctccagtgaggagacctagccaagaaataaggggttttgagccatcagcattttgattctatgaatgaaataaatggtagtgcagggatcgcacctgtggagatgcgaagaggagagagaagacaatcaaaggcagcacttggaagacaccagcattcgaagggtgggcagaagaagggaaccaccaaaagaacacaagaaagaagaacccagagaggtgggaggaaaacaagagagaaaggtgttgggatgctgtgttagtccattcctgcactgctctaaaggagtacctgaaggtcgggcgcggtggctcacccctgtaatcccagcactttgagaggatgaggcatgtggatcacttgaggccaggagtttgagaccagcctggccgacgtggtgaaaccccgtctctactaaaaatacaaaaatcagtgggtctcagcggtgcaggcctgtaatcccagctactcaggtggctgaggcataagaatcacttgacccagatttattatccaacgataatagggatatatttccactggtgggggaatggagggcattctttatctctaccagggaatgcccccagggtggaagtttgactgcaataggttgaggaggtgaggaagtggtggtatactgtgtttccagggagcttgtccacaaggggaaagagaaaagagcgaagtcactcatagagtagcttcccaggggaaggaggatgttcttgttaagtatagagagtctgaaacaggtagagaggcgcggggcagagggaagtggagagaagttgggaatgtgtggatgtgagggaggaactgtggggcaaagtctcagaagagatgggtgatgaggtcaaaggccaggtggaggaattaatctcaaactagagaggggacaacttttccttcataaagggtataaatcctcttctcaaagatcttaaattctgtcttacaggacaaatgagacaatgtgggttttctggatttgaggatttgtttgttttttgagatgggatctcactccattgcccagactggagtgcagtggcacaatcatagctcactacagcctcagcctcctggactcaagtgatcctcccacctcagcctcctaagtagctaggttgacagacatgtgccactatacccagctaattttttttattttgtagaaatggggtcttgctatactgcccaggctagaggtatattttttttctttgccaaatcctgttgattacatagatgtgtatttaaaaaaaaaaaacaaactatagtatggatagggaggggaaatgtgcagtgagagaagccatgctaggggaggttaaagagggggccacacgccatagctcaatgcttcagaaaggaagctgaccaaagctggctcacactgtgtcttggctgaagtatgttgggacatatgacccacaaggaaatctcatggctggcccaggccagtgacatcctcacattttaggggatctcatcagaattttgtccccactaaaagcctgcaaagcccaaagaggtgggccaccaagtggacctcccccagcctaagaacgaactctctttgcttcttaaaggtttggaagcacaattgaaagctggaggcctgagatggttcccgtgagtcacaacaatttacaaagtgcctggcggtaggttatgggcagagacttcgtggggctgtgtctgagggaaggtttgcaggcattgttttctctgtccccctctccaccaagaagtagctctctagagtccctgaccccaaacagccatgggcagaaatcagaaaacagcttccttctgtctgctgctctccccacctggccatcttcactttatgagagtgatgacatcgactccatcacgtctgagatggaaaaggctctcagctactcccaaaaggtatgccctgggcatgggccaatgaccctcagcatggccatctctgcctccgcaggtgggccctgaacctgcggtgtcggggcagcaggaacgttctcagcgccctgcggaaggctgtggaagtagacttcaaggacaaagacaaacaccaatcgcagggaatctacctcttcactgggggcatccccgaccaggacatggtgggtaggccacgtcctgggtgtccattatcctttgcgacctcatccgtcttcccccaggtggataccttgccaaggtttctgcagcatgatttctaaaccagtgcttctcaaactttaatgtatagacaagcacctaaggatgctgttaaaatgcaggccctggagaccagcctgggcaatatagtgagaccacatttctgtaaaaatttttaaaataacctgccatggtggcacatgcctgtactcccagctactcaggaggctggggtgggaggatctcttgagcccaggtgctcgagaccagcctggacaacatagcaacaagaccccatctctacaaaaataaaatttaaaaaattaaccagatgtagccaggcacagtggctcatgcatgtaatcccagcactttgggaggctgaggcaggcagatcacctgaggtcgggagtttgaggccaccttgaccaacatggagaaactccatctctactaaaaatacaaaattagctgggcgtggtggcacattcctgtaatcccagctactcgggaggctgaggcaggagaatcgcttgaacctggagggggaggttgcggtgagctgagatcacaccattgcactccagcctgggcgacaaaagcgaaactccatctcaaaaaaaaaaaaaaaattaaccaggtgtggtgacatgtgcctgtagtcacagctacttaggaggctgaggcagaaggattgcttgagcccagcaggtcaaagctgcagcaagctatgtttatgaccctgcactccagcctaggcaacagagcgagaccctgtctctttaaaatacatacatacatacatacatacctacatagtgcagatcctggttcagtaggtctggggtggagcctgggagtctgcatttctggcaggcttccaggggatgtggatgctactggtctagaacatgcctggtatcaggaggctctcaggtccagctccccaaccacactctgttaaaatattgagagaaactgcaacccagcctcatctctttccatccttgtgccaaggactggaccaggcacagagaaggccctggagaaacatggccaggctgggctgcccagagccccacagcttcaaggccctcagctgctggcccctcctaccttctcttccccaccagcctacactcagtgcctacatggctgaggcctgtggcggctgcgacctccagctgaacgtgtgtctcttctacgtgggcgagccaaagatggacaccacaccccctgcccgctatgccagtcacactgacacagccgccgcctacaaggaggtcacccgggctgcaggtggccgcttccactggtttggagacacaggtacatgactgtttcctcatcccttcagctcattccaaacagttgtctcagcaccagcatagctcccttagaccacagatgtattccagaaaagcagcttgtgaaaatcacattttaaaatgtaaaactgttcctctgaagatagatagcagtgatggttgaacaacaatgtgaatgcacttaatgccactgaattgtacaattttaagtgattgaaatagtaagtttgatgttatgtatattttactgcaatttttttaacttaaaagaagtaggccaggaacagtggctcatacccacaatcccagcagtttgagaggccaacgtggtcagatcgcttgagatcaggactttgagaacagcctggccaacatggtgaaactctattaaaaatacaaaaaaattagccgggtgtgatggcacatacctgtagtcccagctactcgggaggctgaggtacaagaaaatcgcttgaacccaggaagcggaggttgcagtgagcagagatcacaccactacactccagcctgggtgacagagcaaaactctgtctcaaaaaaaaaaaaaaaaaaagaagaagaagaagtaaaactctaaaagtatattatgagtcaggtggtggctcacacctgtaatctcagcactttggaaagttgaggcgagcggattgcttgaatccagttcaagaccatcctgggcaacatagcaagattctgcctttacaaaaaaattaaaaattaaaaaatatataatttagaatgtcatagaatgtcagagctagaaggcaccctgaacatcccttagattgtttttcaaagggtggtgtgttcacagcacatggttggcaagatagttgtacatggtacaaaaagcaacattttttttagagacggggtctccctctgtcacccaggctggagtgcagtggtgccatcatacttcactgcagcctcaacctcctggattcaagcaatcctcccaccccagcctcctgagcagctgggactacaggtgtccaccaccacgcccagttaattttttaaatttttttttatagagaaggggtctcactatattgcccaggctggtgttgaactcccaacctcaagcaatcctccctcctcagcctcccaaatgctgggattacaggagtaagccaccattcccagccctcaagtcacctccaggtggctttctagtatccagatgatggggacgcttgccaggatccacaccctgtctcaccttgctcacgatgtgctttgtttccaggcatttatgagagcgatgacatcaactccatcatgtctgagatggaaaaggctctcaactactcccaaaaggtatgccctgggcatgggccaatgactgcactgccttttgtattcatttcctggggctaccataactgccacaaactgggtggcttaaaataacaaccattgattctctcacttccagaggctggaagtctgaaatcaaggtgtcagcagggccaggctccctctgaaggctttgggtagaatctttccttgcccctccctggcttctggtggcaattggtgtttgtttgtttgtttgtttgtttgtttgtttttaattgcactggttgctcttttaaaatggcaaggaagactttacttaagactattgcaataggggagagagactgaactcaactctaaataatagcaaagatagctggagatttatagccaatgagcagtcagtggatggaaaaattactaagagaactggatagataggatagataaaaggattcttgttaaacagggctcttgctaaaggcagaccaaaggcttagatgtcaaaaatagaactgggcacagtggatcccacctgtaatcccagcactttgggaggccaaggtgggctgatcgctggagcccaggagtttgagaccagcctcagcaacacggtgaaaccctatctctgttaaagaatttttttaaaataatttttttaaaaaaggtatctcagatgggagatgaagaacttgcttggatatcaaggatgggacaggtctcactaaactgacttagcaaaattctttgccaaaactgagttcggcaggccaaggtcaaggcctcattgagaagatggcttagaggagccggctaaagttcggtcaaggaggcagtccttgtcaccagcaatctctggcattccttggcttgaggagcataactccagtctctgcctctgtctttacatggctgttttccctccaggtgcatcccttctcctcttacatggacaacaatcagattagattaaggacctgcgctactccaatatgcctcaccgtaatttgtatcttaattacatctgcaaagaccctatttctatgtaaggccacatgcacaggtcctgagggttcagacttcaacatatccttttgggggacacacctcatcccatgtcagcttccctcttcatgtcctaatccactgagacccaaggcttcagaagaaatgagtgtctcctagaagccattggttttaggtctgtgtgctgcacattctggcctcctttgagttccttaaacacgtcaaggttattgctaaacccattcctaagctcagggcctttgcacctgctgtttcctctgtccttcccatcccagacctttcatggcttgctccttatcattagttagggttttgttttttgttttttgggggtttttttgagacagagtctcactctgtcgcccaggctggagtgccattgtgcaatctcagctcactgcaacctctgcctcctgagttcaagcaattctcctgtctcagcctcccaagtagctggggctacaggcacccgccaccacgcctgactgatttttgtgttttttagtagagatggggtttcaccatgttggccaggctggtctcaaactcctgatctcagctgatctgcctgcctcagcctcccaaagtgctgggatcacaggcgggagccaccacacctagcctattagttagtttagacacactaaaatgttacttcctcagaggagttgagcaggacaagatacaatgagagaggtagctaggagccagatcccgtgaggagcaatgactatctaaggaagaattccccggacttgcaagtgattgaacgggcagtgtgaaagagaaaacatacaaactgacccccacgctcctcactggagcacccagtagacagtgaggccattgaccaagatgtagaaaacaggaggaagagcccatggaaggacggagaggtgcagggaaggcgggtctgggacaagggtgagtttgtggagcctgtgagataacaagtgagggtaccctacaggcaggtgggaaaagacatggctggagatggagatttagggcagttcaagccacagtgacggacagagggcacttagcaaggctgtggtcgaggcagtggagtggaggagcctgtgaaggagactcctggactccaccacttgcagaaggactcacttcccagactggattgtggactcctgggagggcagggccacgtctccatcttctattcctctgtggccactggatctgcagatctgtggctccccctgcgtgcctgtgctgtcttccccaaaagggacccttttggtgcttttaaaatatctcttcccagctgggcgtagtggctcatgcctgtaatcccagcattttgggaggctgaggcaggcagatcacaaggtcaggagatcgagaccatcctggctaacatggtgaaaccccgtctctactaaaaatacacacacacacacacacacgcacacacacacacacacacacacgcaaaattagctgggtgtggtggtgcgcacctgtaatcccagctatttgggaggctgaggcaggagaatccttgaacccgggaggcagagattgcagtgagccaagatcatgccactgcactccagcctggcaacagagtaagactctgtctctaaataaataaataaataaataaataaataagtaagtaaataaataaatatcccttaccctcaggtgcacatagtcccattccctcatcagataaactgatacatatggtgttaatgggcaatgaccgcataattcacctttccagaggatgcttatttacatttgaatggtgtcttctggagctttgattgagaataattgctggggaaccagtcaggctgttgagaaaatcgtaggcaaaaggcattgagtattacaccattagtctgccagcatctggaatcagccctggcatgcggcaagctgactggcccacaagtggaggccacagtgtctcataatggaagggtgctggctttggaaacagacccacctggtttgaattgaagtttctctacacactgataaggtggtcttagatgagaaccttaagctcacagagctgtaactgtaatagatctgtggccagatatgcatggcaagtcaatgcacagagacactgggttgcagcagagaaaagaagtttaattataggactgccaaacaaggagatgggagggaacctcaaatttggtgttaaggtttttaagggttttgcagtgggctgaagtatggagatcactgactagttgagtgcaggctggagtcatgggcaggggagatgaagaagctgtgttctcatgctgttcctgttcctctgggggtcttcaaactgttggcatcagctgctttgctggaattcgggtctgaaaaacatcttaagcaattcttaaacaaaagccttgtgattctgaagtcagaaatcctatctagaggaacaacggggatgcaaacagccaggatctggtgctatgtgactttaggttacaaagaagtggggctatgtgcagcctgatcagggcttcatgataactagatttttgtccagaattcttgttaactctgtgatgacagcttcagagctttggtttcctcatctgtaaaatggggagacgacacacctaccctatcggcatagctgatgtgacttgttggcatgagggttggagacccccaagtattcactagcccagagcctgtgcctcccaggcccccatacctggtcttactgttgttcataggattggtccatagcactttcagccccaggtggctttctagggacaaaaagaggagtccaggggacatcagaggttccagtggatacagtccctcctgctgtgtgtgtgtgtgtgtgtgtgtccacagtggctgggggtgccactgaccctcccaatcccactgcagtgtgccttcctcatggcctccctgaagaaccattcaggaaaagtactgggaagttcagccctcccgaaagaaaaaccaaagacacttcagctaagaagtcagcccaagaagctctgccctcccaggcccaccgtccccctgggggccagaatggtttgactcccctcctaataacacgcagaagatttggtttcctgtttgtcttctggtctttcctgggtcttaaaatggctggggccagcagggatgggggtgggtgcttcagtggtgagtgtcctgtgggtgcctcttgcccaggcctccagggggaaaatctcccgcggggggccggctcctcagctctcggggtcctctgtcctcccccaacccacccttggctctgtcagcctatcccagccttttccctaccctggtactgaggatgccacagaattgacacccacctgtttcatctgatggcttatcctggagagtctctcgggggcaaaggaattatggtctctaagggctcttcccgctgccacccaagactttgcagaggctgataggagcctgagggtgggctgagcctgctaggggcttatcctcattcacagcctatcaattctgtcctccataaaatacccacccaccttggcaatcagaagggctctagaggacagaccccagaggcacctgtgcttgtgagcagactgggagggacacctgtgagtccctcagcattgcatgactcagaccctgtgagcacagcccatgttcagaatgtggaaatccatcccagacagtaggtagcagatttccagccaaagggctgcctttccaggagagcctgtgcagccgggttctgccctcgttcggggaactctgccaggtttcaggagccagctcaggcacttcgccccctcctcagaggctgcctcttgagccttcagtgcttcctgagtgcctcctgaaaccaggccgggtgctccccagacagtgactgtttaatgaccgccacactccagtcgtggctgagaatgaaggaactcttcccttaaaactgaggtgtctgggccaggtgcagtggctcacacctgtaatcccagcactttgggaggccaaggcaggcggatcatgaggtcaagagatcaagaccatcctggccaacatggtgaaaccccctctctattaaaaatacagaaattagccgggtgtggtggcgggtgcctgtaatcccagctactcgggaagctgagacagggagaattgcttgaacctgggaggcagagtttgcagtgagtcgagatcacgccgctgcactccagcctgggtgacagagccagactccatctcaaaaaagaaaacaaacaaacaaaaaaaaactgaggtgcctgataaggcacagaagttacctaaatttctgttgtcatgctggaggcccagacatcccagtccattaggaagaggggcaggtgactgatgaaaaaaattctggcaaacccccatagctctctcactagcagctctctcactctcatctcacacacacacacatgcatacatacacatatgcacatgcacacacatacatatacactcctacacacatgtacacacccatactttttcacctcaaaacccagagtcccttctgaatctgctgcaggagaggggccaaacctgtctgaggagtcccctcccttaggctcctccctacaaaagttcctgattgacaaattgaggtcagggtaactgggatcctgcgtgacacagggaacactcctctgatgggaaagattgcctgttttctagagcattaaagatgaccctgacagagagaagagccccccgctgaaatctctgaaatggcgtccactcagtagcagagttggcatctcaccaggtaaggcaccatcacggtcaggcagggtggagggatgtcacggtcacggctgaggcatgggttaataatgatagtaactagagccacgtgtggaagctcgtgcctataatcccagcacttttggaggctgaggtggaaggatcacttgaggtcaggagttcaagacaagccttgacaacatagcaagactccatctctaccaaacaaaaaaggagccagatgtggtggtgcatgcctgaagtcccccaagtactcagaggctgagttgggaggattgcttgagcccagaagttcgaagctgcagtgagctatcattgcaccactgcactctaacctcagtgacagagcaagaccctgtctctacttttttttttttttttttttgagacagagtctcgctctgtcacccaggctggagtgcagtcgtgtcatctcagctcactgcaacctccacctcctgggttcaagcgattcttgtgcctcagcctcctgaatagctgggactacaggtgtgtgccaccacgcctggctaactttttgtatttttagtagagacggggtttcaccatgttgcccaggctggtctacaactcctgagctcaggcaattcatctgcctcggcctcccaaagtgctgagattacaggcgtgagccaccacgcctggccacatctcttaaaataataatcataatagcaataatgatagtaactaaaacgatcaatgatcctgagtcttgatcatgtgccagcccatctgctaagattgtcccatttaaagcctataatgatcaatcctttgcatctgtattctatcagcttcctattgtactgacaaaggaactgaggctcaggggggtaaggatcatgtgccactagtggtaacaggccttcacaatcttaatgaaagtactcagctcgtagaacctaagaccatgtattttatttctaatgtcaaaggtatggcagagtggctcagagcagagttctggagtcagcaggaccaggtagaatcatgccctgcctcttactggtggattcccacttaccttatctgtaaactgggggactgtgaggatgaagcaaggcagcatactcaaagcacttagcacaatgccagggaaagatctggactcagtaaatggtagctatagctatttctgatccaagcaaagccagagacctggcgggggaggacacagggtgccttgaagccatcttggagccccatttcctggggtggagtatagctgaacttgagtgtctctaagccaagctggacagctgtattgcaagaatgcatgcagctgctccagccaacaagccaaatgttcctcagctgcggcccagccaacgaaagaagggatgatggaactgaggaggaagaccaagtcaagggaagcagagacatctcttttactgttctacacagagaaagggaatgacgtgggtaagttagaggctatacaggtgtctggacagccccctggccctgggggagctgtaagggcagcaggtaccgtgggaaggagacccctcctgctgtcccaggacctaggcactggtgcctctggagcaagccgtactcaactcagttctcccagccctgggaaatggacatgcaaagttttgacaacaaccagggaatgagagaagtcaatattgaagatgagacctcctgagattcttgggcactccagctctgtccactaggggcagtttccttagctctaaggcagatggcaagggatggagatgattcccctaggccagcctgattcactgctgtgaaatggtgcagatcccaagaacaattcattgctaggcaggaggtcccaaacagcctttccccatccacccaacagctccctttctacctctcagcaaattgcactaaggacttttacaactgacttgattgacagagaaattgacatgaaaaagggagcagtgggagattcagggggagggaagagaggtacacagggtgaccatcttagttcatttgtgcttggaatacccaaggctaggtgatttatgaagaaaataggtttttttagctcaggcttatgctggctggaagtttgggcatctggtgagagcttcaggctgcttccactcatggtggaaggcgctggggagctggcatgtgcagagatcacatggagagagaggaaacaagaaaatggggaggtgccaggcttttatttaacagccagcccttgcggcaagtaatagagggagaacttactcgctccccaccctctcaccagagagagcattgatctattcatgagggatccgttcccatgacccaaacacctcccattaagccccatctccaacactggggatcacatttcatgaggtttgcaggggctcaaccatccaaactatagcaatgacctcactctgcttcttctaggctcagtgtacaagaagtaccctcaaggaaggggcttgagaaggactagctcttctattgacttacccagaaaggatacagtttgctcaagccaagaggtattaagtcacccatactagcacatgcccattaagcaatagagtagttctgtccaccaaccattacttctaggatgggggggcataatcagaaatgagaacaagccaggcacagtgactcacacctgtaatcccagcactttgggaggctgaggtgggtggatcacttgaggtcaggagttcgagaccacctggccaacatggtgaaaccccatctctactaaaagtacaaaaattagccaggtgcagtggcacgcacctgtactcccagctacttgggaggctacatcatgagaatcacttgaaactgggaggtggaggttgcagtgagccaagattgtgccgctgcactccagcctgggtgacagagcaagactctgtctcaaaaaaaaaaaaaaaaaggacaaacctgataagaacaattgcttactgtggcagatgggataagggttaaatagacctaaattcaaaatctaggtctgccacttcctgcctgggtgaccttgggcaaatcacctagctatactcaatctcactgcctttgtaaaataaggacaattgtgccagtcaaataagattgatgtgaagattctttaaagtgaaatcaacagaaatcccacttcttgtgcataaggggatagttgtcccacagctattcaataaaagcctgagcatggttctgattgtgccgatggcagatgccatccctggctgctttgagcctgcccattcttgtgtccctcattgtgacaaggagactgagattatcctaattggcttagagtctaagctttagaccaatcagggctttccactcaaatattgtaggtggggtgctcacttcagcagcacatatactaaaaaatgttgtaggtggggttgaaatggatgttagggaagtaacagtgtccactagactagggtctgggaggtgcgcgatagattttgttcttcacccccactatttctttctttctttctttctttttttttttttttgagacagagtttcactcttgttgcccaggctggagtgcagtagcactatcactgcaacctccgcctcctgggttcaaacgattctcctgcctcagcctcccaagtagctgggattacaggcatgcaccaccactcctggctaattttttgtatttagtagagatggggtttcaccatgttggccaggctgttctcaaactcctgacctcaggagtttgagaaccaccgctgtcagcctcccaaagtgctaggattacaggcatgagccaccgcgtccagcctgcacccccatatttcttgtgcatttctcccccaaagccagggaaggaatctgcatgggatggatgctctgtgaggacctgggaatcccacatttcaaacatcatacaggtttcaaacatgaggttctcatagaccagtcagatgatcattcagttgagtctgaattgcctaagataatagttctttcctttattctaaagtgggtggcaaaatatgggctcaaaaaattgaagctggagatttccagatgcatgggtcccaactgcactcatcaaaagtcaggacagaggtcagcatccgccaaacactgcagcatcttccccagcgttgagatccatgtaagtcacaattttcatcatcgtcttttttttctcccccaactcagctgcaaatggcagagagcagtgtagggcactgtggcctctatttctgcttgtaggaactgccctcctccccaaagtgggactcccctcaccaaataggagatgcaaaatcctgttggaagaaaagccaacttcccagagggcctaagatcccattccagggttagatgagctcattggaataagaattataaacaattgccgaggccaggtgcggtgactcctgcctgtaataccaagtgctttaggaggctgaggtgggaggattgcttgagcccaagagtttgagaccagcctgggcaacatagcaagaccccatctctgaaaaaaaattagattagccaggtgcagctgtgtgcctgtagtccgagctacttgggaggctgaggcgggaggattagttgagtcatggagttcaaggctgcagtgagccgtgatcacgccactgcactccagcctgggccatggggcaggagcctgactcttaaaacataaaaaggaaaagataggaaaaatagcaattgctgagaagattgggccgtggctgaagtgttcacccataagaatgctgtaccccaatactgatgatggttctgttatggcagcaaataggggttgtgataggaagtgaagggttctcttttctattttctaattttggggtgattttttattgctttgacactggaacaagtaaatttagtacagaatgaaaatctgatcatttctctccttgccctcttatcctacattgtcaagattaggggaaactaaaaatagccacaaaattcaaaattattcactagaggaatatagggtcattctagcatgttgcccctctccacctgaagtcatctttcagttcaaaatttatgaacttcttaccccaccatttagagttttctattttaaaatttagagattattggccagacgcagtggctcatgcctgtagtcccagaactttgggaggccaaggcgggcggatcacctgaggtcaggagttcgagaccaccctggccaacacagtgaaaccccgtctctactgtaaatacaaaaattagccaggcatggtgctgtgcacctgtaatcccagctactcaggaggctgaggcaggaaaatcgcttgaacccgggaggcagaggctgaagtgagccgagatcgcaccactgcactacacagcctgggcaaccgactgagactctgtctcaaaaaaaaaaaaaaatcagaaattattatgatttttattaatatagcaactgcatttaccaaaaaaaaaatcttaattccctactcctttgtagaaccataaatccactagtttaatagaagaaaaaaaggctttaaacaaaaaaaaaaaatacacttaacagatggttgttttttgtgggtttttgtttgtttgttgagacaggatcttgctctgtcatccaggcaggagtgcagtggtgcaatcacagctcactgcagcctctacctccctgggctcaggcaatcctcccacctcagcctcccccaagcagctgggaccacagacacatgccaccacaccagctaaattttctgtttttggtagagatgaggtctccctatgttacccaggctggtcttgatctcttgggctcaagcgatcctcctgcctcggcctcccaaagcgctgggattacaggcatgagccaccgtgcccagccaacaaatattttgagaattgttaaccacaatggaataaacaattttagggggtgatggggatatgaagaaatgactgatggggtgggtgcttgcctctgcttgccttaacccagggagtggtgagacacatccagtggacgcccagggagatggaggtgtacatcaggcacttggagaaggtgttaaggcgctatgtccagaggctgcagtggctgctgtccggtgagcctgcccactgccctgaagggtggaggagcatgaggggatgtagaaggctagccccagggaccccagtgtcagtccttccaaagccaggccttcaagaactgcagatcagaggattaggccaggaacatcatccacatacaacatgacactgggaggccgggcgtggtggctcatgcctgtaatctctgcactttgggaggccaaggtgggtggatcaccagtcagtagttcgaaaccagcctggccaacatgatgaaacccgtctctactaaaaatacaaaaaattagccaggcatggtggcgggcacctgtaatcccagctactcaggaggctgaggcaggaaaatcgcagaggttgcagtgagctgagatcgcgccactgcactccatcctgggcaacaagagtgaaactctatccaaaaaaaaaaaaaatgacagtgggttcagaggacaggcaaggggctggataacagggaggtggaacatgggccaaagagccccagcgggagctcacacgcatcccagcctgctctgcaaggccacctgccacaccttgccttcctgcaagtgacaaggggctcactgtcaaaaggtttgctttaatattgactgcgccccagcaaaacagcccctggagatgcagatggtaaggggaactgacagagcagaaaccctctgttttgttttgttttagaaacagggtctttctctgtcacctagtctggagtccagtggtgcagtcatggcttactgcagccttgaactgggcacaagcaatcctcccacctcaaccttgcaaggacctgagactacaggcacgtgccaccatgcccagcttactttatttattttttttagatacagagtctttctatgttgcacaggctggccccgaactcctaggctcaagctatcctcctgcctcagcctcccaaagtcctggggttataggtgtgagctactgtgtacctctttacagagagcaccaagtcccctccaggagaggtgaatggacagggttgggctgtggattaagagacggtctggaagcatcaagcccaagaagacaggcagacagctagaactggacaggaggggattcgggctatggggcctggagggtttctggggcatcaggaggagggaggaagggagtcctatatagagatcctacaggtggctttgtacgtgccactcagggtcctgtgtaaattcattaggtccagtcctctgcagtaggacctggtatagacagtccatggacaggggcgtcatgatgactgctgcttcaggtacagttgtcaggtcagaggctgagctgggacagagaaggcgtgagcctctctccaccctcggttcacattacccctgggaacggtgacataaaaccagagatccagcgatttcttttgtagtatgaatcccccagctcacataccagtacacacccaaacaccatctaatattttaaaacaatgtcatggtactatttaatccaatcacttaactttaaggataaggaaattcaagcccaggaggttataaccgcttgtgcaactcatcacagacaaagccagagctgaaatctcgatctcccaaagcccaaaccactgaccaggtctgtccttggacaatcgacccctcccacagcaccacaaaagccgtctctcagtggggtgacatccaatcaatgatcaggcaggcaacaggtgtcacaagactttatacttgatagatagagtgagggaaaccacccaggaggagggacccctcactccctccctgcctcttccccacctgtctcggagcagggagccgccgactgtttggcaccgttttggagagcaaagtatgcatattgctggacacgtcagggtccatgggcccctacctgcagcaggtgaagacagagctggttttgctgatttgggaacagctgcggaagtgctgtgacaggtaggaggcgagggctgatcaggaagatcaaaggggcagttcctggggcttccctggccaagcacgccccctcttctcagtgccaacaggcctggagtttctgagatgctcttctgagtaacgcgtttgagtaggaaagagcactgtattctgctctgctgtgaaggaaatcagtttttagaggccgggtatggtggctcatacctgtaatcccagcaattttgggggccaaggcaggaggatcacttgagctcaggaattcaagaccagtctcagcaacaaagtgtcatcccatctcttcaaaacatttaaaaattagctgggtatggtggtgtgcacctgtagccccaactacttgggaggctgagaagggaggatcacttgagcccaggaggttgaggctgcagtgagctatgattgcaccagtgcactcctgcctgggcaacagagtaagaccctgtctcaaaaaaaaaaggaacgcaatttttaaaaattaatttcaggcctagggacaattgcaagcacagcaaaggaactaccatgtggccttgaagtatggctttcagctgaacttgatttgttttaaattatttaatgatttaatttttttaatttttgtgaacttgatttttgagtggaggaagttgtttattttccccatccagaagggttgacccgaaggggaccccaggggactctcatcgtagactaggcctcgttcttgccttaatcagagtatacatttattgagcactttctgtgcaccagatgctttacacgcatcatttcatcaactctcacaatgagcccgtgaggtgttgctgttatcggcccccatttttcagaaaaggaagccaggacttcaagaggttaagacacttgctgaagatcgggtaaccagtcactggctgagataggattgtttgggttgtttgtttgcttgtttgttttgagacggggtctcactctgtctcccaggctggagtgcagtggtgtgatcatagctcgctgcagcctcaacgtcctgggctcaagtgatctcccacctcagcctcccaagtagcttggactacaggcgcacaccaccatgcctggctaattttttaaaaatctttttcgtagagatgggggtctcactatgttgcccaggctggtcttgaactcctggcctcaagcaatcctcccagcttggccttccaaagtactgggattacaggcacaggccactgtgtctggcttgggctgggatttaaatctatttctgtctgcattcaaattgtcagtgtgtaccctctcattctcaagaggccccacagccctctccctgaggggccacagggctcgttgtaggggtcttcagtgacgagcaagaatagtcctcatgagggtaacttatctgaattcaatctagacaggcctgttctaaccaatctctttctccccttctctgcccctcacctcctcttttcctcctccccagttttaacctgctcagctttgcagagagctttcagtcatggcaggacacgctggtggagaccacagatgcagcgtgtcatgaggctatgcaatgggtgacccacctgcaagctcagggcagcacctccatcttgcaagcattgctggcaagtcccaccacggagcccgaccttgacgcaaaacaaataccatcatcccctatgctgatgctgcacgatgctttaggatttacaaagggcgctttataatttacaaagcactacatcatttcatcttcccaacacccgagtgagaaaaggattctcaatgttctcacattatagatgaagacacaggctgggtgcggtggctcacacctgtaatcccagcactttgggagggcaaggcaggtggatcacctgaggtcaggagttcaagaccatcctgaccaacatggtgaaaccccgtctctactaaatacaaaagattagccgggcgtggtggcacatgcctgtaatcccaactacttgggaggatgaagcaggagaattgcttgaacctgggaggcagaggttgcagtgagccgagattgcaccattgcactccagcctgggcaacaagaacgaaactccatctcaaaaaaataaaaattaaaaaaaatagatgaagacacagaggctcagagaggttaagtgacttgcttgggattaaccagctaggcagtgaaccatgctatttctcctaaacctcagcagcttccttagtctgtctgaggctgaaagagaatctcagtctttttgaacaggtcagtggcatccaatcagatgcattttggcagaggcggcagcaggcactacctttaggcatttggttcttgtgttctgggtgagcctctcccctgagcctgacagccttcctgcgttctttcagaaagctttcagtttccatgatctggaaggattgtacctcctgaccgacggaaagccagacacaagctgcagccttgtcctaaatgaagtccaaaaactcagggagaaaagagatgtgaaagtgcacaccatttccttgaactgctcagacaggtgcgcaatatggagtctgactgagttttattctttttccacagccacacatctcagcagggagatccaagcccctcacctaatctagctgctcacttagacacgggtttctcctgggccctaatcctgtaaatcagaaattaggagaagcggccgggcatgctggctcacgcctgtaatcccagcattttgggaggttgaggcaggtggatcacttgaggtcaggagttcaagaccagtctggccaacatggtgaaaccctgtctctactaaaaatacaaaaattagacaggtgtggtggtaggcgcctgtaatcccagctactcaggagactgagacgtgagaatcacttgatccagggaggcagaggttgcagtcagcggaggttgcaccatggcactctagcctgggcaacagagtgagactgtcaaaaaaaaaaaaaaagaaagaaaagaaagaagttaggagaagcattgtttttctagacggcccaagccggtgtcacaccacagggtgaaaacccctctctttacccagatatttccctctgacttcctccagcctggaaacacatttgcaagggattcacacagtcattttacagtctccctcctactcttccctgggatcacatttgtgaatatttaggggacatttaggggaaaagccagagagaaaaatattaatgtagcattgtcatggttatttttttttataaacgatcactatagaccatgtgctatgaccgggcacaatggctcatgcctataatcccagtgctttgggagactgaggtgggaggatcacttgaggccaggagttcgagaccagcctggatatcatagcaagattccatctctacaaaacaaaataaaaatgtgaaaaagaacacatgtcagataagacatactcagctccttcaaaaaaaaaaaaactttattattagcaaaacagactgcatagggacacattttatctcttggtctaaaccatgagccccataagtgtaatatgtgtgtcctttacaggcctaacacatagtaggcactggataaatgtcccataaataaatgggggctaggctgagcacgacggctcatgactgtaatcccagcactttgggaggccaaggcaggcagatcacctgaggtcaggagttcgagaccagcctggccaacatggcgaaaccccgtctcaactaaaaacatacaaaaatgagccgggcgtggtggcaggtgcctgtagtcccagctactcaggaggctgaggcaggggaatcgcttgaacctgggaggctgaggttgcagtgagccaagattgtgccactgcactccagcctgggtgacagactgagactctgtctcagaaaagaaaagaaatgggggctggagtgtgtgggctgtgtggtttcagggggtccaggctaaatggtgacactcacacggggactcctcttccctcaagcagcagcagttgctatagctgtccagaagctggtggggaaagtgtcctctaatggtggtctccatgggacaagccacggcccattgccaggctgatttctcttaagccccacggacttaagttccccatggacgtggggagtcacacgaacttgcctggtcagtcagccttcccaccagccctctgtcccttccttccagagcggcggttgagttcctgagaaagctggcttccttcaccggcggacgctatcactgccctgtgggtgaggacacactctccaaaattcacagcctgctgaccaaaggcttcatcaatgaaaaggtaggttgcagagccactgagcatgaggtctgttgaaacggctcgataaaatatcaacaggcatggggttttccttcttgaactcctgggctcaagtgaacctcccacctcggcctcccaaaatgttgggattacaggcatgagccaccacgcccatcctgggttttccttctgacgaaaaagatctctgcttttcgttgagacaaaatattagctgaaaaggattgggtttccctgctgctgtccttttaggctgactctcctcaaggctgggaaagaagcaggatttgagggtgttatatttcctgatggtcaggccagtttgcctttgttggaaatttatgtggctttatgtagataacctcttttaatattatacccatttaacaggtgaacgagagggccagcaaggtttaagaatacacctaaagctgggcacggtggttcacacctgtaatcccatcactttgggaggccgaggtgggtggatcacttgaggtcaggagtttgagaccagcctggccaacatggtgaaatgacgtctgtactaaaaatacaaaaattagccaggcatggtggcatgcacgtgtaatcccagttactcgggaggctgaggcagaattgcttaagcctgggagacccaggttgcagtcagccgagattgcgccactgcacttcagcctgagtgtcagagcaagactccgtctcaaaacaaacaaacaacaacaataaaaactagtcagaggaagtggtatagctagagccccaagacacccatgatcttaaactttgtgctttaattcctgcatatttgtgtcttctggggttcaattcattgaaatacagacattcaagttatctgttaagcaatagatctggcaaagtcataggttatctattaagtaataagtctagtaaagtcatagatttcaatgatccacttctgacttaataggaaaattctgcacttatttataccttttaggaatgcaatgttgtcagtgataacattcccagcgcaacaaattatcaagtaagacaaccaatcagaattccagatttcttttcagaggttaaaggttactttcacaggacatggcataatttttttttttttttttttgagacagggtctcattctgttgcccaggctagagtgcagaggaacaatcacagctcaccacagcctccacctcctgggctcaggcaatctttccacctcagcctgcagagtagctgggatcacaggtgtgccaccacgcccagctaatttctttaattttttgtagaaacaggatctcaccatgttgcccaggctgatctcaaactcctaggattaagtaatcctcccgcctgagcttcccaaagtgttgggattacaggtgtgaaccgtcaggctcggctggcataatctttgaagcctgggtagccttacatgactcctttggttcaactagctcttctagggacaagtattataaataatacagagaactgaacaaattggtaaaagtaatgaatattcacccaagcgtccttattacacaggaaaacaagtgatgatatgtttaaggctctcagcttaattccttatccaatcagattctctgaattgtttttgcatgcagaatgggattgctgtgctactactgccaggcagaagggatggcttcctcttttttctttttcttttttttttttttttttttttttgagatgaagtcttgctgtgtcaccaggctggagtgcagtggcatgatctcagctcacttcagcctctgcctcctgggttcaagtgattctcatgtctcagcctcccgagtagctaggattacaggtgcctgccaccacacccagctaatttttatatttttagtagagatgaggtttcatcatgttggccaggctggtctcaaactcctgacttcaagtgatccacccgcctcagccacccaaagcgctgggattggtaagatgtatttttaaggataggtggcgaaattttattagttaacattttttttaaaaagcatgcctcagccgggcgcggtggctcacgcctgtaatcccagcactttgggacgccgaggcgggtggatcatgaggtcaggagatcgagaccatcctggctaacaaggtgaaaccccgtctctactaaaaatacaaaaaattagccgggcgcggtggcgggcgcctgtagtcccagctgctcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaagcatgcctcagccaggtgtggtggcacatgcctgtggtcctagctacttgggaggctgaagtgggaggatagcttgagcccaggaggtcgaggctacagtgagccgtgatcacgccactgccctgcagccaggacaacagagcaaggctctgtctctaaaatcaaccaaataaaaagcatacctgtaagtctacttcactagaagaaatgcaaaaaatggctgaacagattctactgaatagcgctgagataaggaaacggtgtcatttctgttccactggaccagagtggggccactttcactcagattctgacaccatcgtactttgccaccgtcccctccctacactgactctcagacaccatatttcaaagtttcccctttgcagaatgactgtcttgataggtagtgagcttcctgaccctggagatatacaagcagaggctcacaagatttcctgcactggatggaaaccagaacgtgattagctctaaaatgcttttcctgagattttggattttcagctcccatccagtcataaacttcacactcatttcctcttttcaaggatcccacattgccaccatttgaaggagatgatttaaggatcctggcccaggagatcaccaaggccagaagcttcctctggcaggcccaatccttcaggtatgcccttcacgcagcctctccggcctgccatgtggctacagcccatgcagaccccggaccccatcgagaagggccgcacccatgatggtacccttgctccaagggttcctgccctgcttctcccagccagcccagaaatctgggcaccagggagaccatctttcttcatctcctgcccaccagatcccaactccagaagaaaaatgatgcagaaccaaaggtcactctttcctagagaagtgttctcaggtaaggggaggggctagaccccatactacctgagtgtgcactaagcaccaagtggcatgctctattttgtggtcaataataactttggttaaaaaataatgattcctctaaacagaaaagtcatcctgcaaaggaccactcactgagcaaatctcagccccgagggcaggatgggatgaaatgctgtgacctgcaggaaacatgattcctggtaccaggactctctggaagctgaggaaggaaagactttgtcttttgtgtgaggggccattcccgggtcttaatctaactctccagccctgtcccgcagcgcactctactctccagccactagattgtccctctctgggaagccctaaaccaaccccctgcctaaatggtggtgcttcttgcaaaccaaccccctgcctgaacggtgcttcttgccccctctgcctggagactcctgctcatccatcaaggcacagctcaaatgacatcagctccctgggacctatctagagcgaggggcctccagtctttctcttgcagcatcctgaccacgcagacctctcgcactcagcactctatgtcacgccaccttgctcgctgatctaactcttctccttgatggtgagctccttcgggatgagactggtgtcccaggatctgcaggtccccagaagctgccacataggagacacatggtgaacagtgagcaggcggctgagctgtgagagcctagctctggaaagcagctgatggggtggtctccaccctggttcataagaggctaatgcagagtcacagtcagcccatcctgggggaagaagaaacaagtgagcctcagcaccaccctccatccctgcccaaccaaactgaagtgaaggctgctcatctgggttcattttctaaaattaaaaacaattaattttattctactaataggatcaacatgactttaactgtttgaagtgatcattggcgtgtgtgtgtgtgcataaatttttagtgacataaaactttattaaaagactcataccataataaagaatttcaataagaaaaagataaacatccatttttttgttttttttggaaacagagtctcgctctgttgcccaggctggagtgcagtggtgcaatctcggctcactgcaacctccgcctcctgggttcaagcaattctcctgcctcagcctcctgagcagctgggactacaggggcctgccaccacgtctggctaatttttgttttagtagagacagggtttcattatgttggccaggctggtcttgaactcctgatctcaggggatctgcccgccttggcctctcaaagtgctgggattataggcgtgagccactgtgcctggcccatctcaattttttttttttttttaggcacagtctcactctttttgcccaggctggagtgcagtggcacgatctcagctcactgcaacctccgcctcccaggttcaagcgattctcctgcctcagcctcccgagtagggtagctgggattacaggtgcctgccaccacgcccagctaattttttttatttttatttttagtggagacggggtttcaccatgttggccaggctggtctcaaacgcctgacctcaggtgatccggcccgactgagactcccaaagtgctgggattacaggcatgagtcaccgcgtccagcccatccaatttttaaaatggacaataggtacatgaaaaggtgctcaacagccttacctgccagggaagtgtaaattaaaaccacagtgagatgccactacactcccactagaatggctaaaataaaaaagactggggttgggcacagtggctcatgcctctaatcccaacactttgcgaggctgagatgggaggattgcttgatgccaggggttcaacaccagcctgggcaacatagcaagaccccatgtctccaaaaatttaaaagaaattagccaggcatggtggcccaatgcatgtagttttagctgctcaggaggctgaggcatgaggatcagttgagcccaggagtttgagactacagttagctatgattgtgccattgcactccagcgtgggcaacagagtaagaccctgtctcttaaaaacaaacaaacaaaaagacaagatggccaggcatggtggctcacacctgtaatcccagcactttgggaggccaaggtgggcggatcacatgaagtcagaagtttgagaccagcatggccaacatagtgaaaccccgtctctactaaaaacaacaaaaattagctgggcatggtggtgcacacctgtaattccagctactcaggaggctgaggcatgagaatcgcttgaacccaggaggtggagattgcaatgagctgagactgggccattgcactccagcctgggcaacagaatgagaccctgtctctaaaaacagaacaaaaaaagaactacaatatcaagatgtggaacagttggaacactcatattccaattagggtaggggttggggtagggacgtataatttgactcaataactttggaagactatttggcaatttctactaaagtaaaacatatgcctactctatgatctagtaattccactccaagggtaatgagtgcatatgttagacaaaagacatataagaatttttccagcagccttattcattagagctcaaaattggaaactacccaatgtccatcagtggcagaatgtgcaaataaaatctgatacattttacagtgaaatattatgcatcaatttaaaaagaatgaacggctcatgtggtggctcacacctgaaatcccagcactttgggagaccaaggcaggtagatggcttgagcccaggagtttgagactagcctaggtaacatggtgagaacccatctttacaaaaaaatacaaaaattagccaggcttggaggcatatgcctgtagtgccagctactcaggaggctgaggtgcaaggatcacctgagcccaggagaggttgaggctgcagtgagccttgatcatgccactatactccagccttggcaatagagtgagaccctgcctgcacccccaaaaaagaatgatctatacagctatattcaacaagatgcatcagtctcataatattgggcaaaagaaaccagacacaaaggagtacatactgtataaagtcatttatatgaagttcaagaaccagccaaactccttattggtgattgaagtcaaaatactagttaccctgtgggatgggggacacaaaggggacatctggtgtgatgaaaatattctatatattgataaaggtaggagttacattgagctatacataagtaaaaattcatcaagttgtttaaaaacactcagttgtggccaggtgcggtggttcacgcctgtaatcccagcacttagggagaccaaggcaggcagatggctcaaggccaggagttcgagaccagcctggccaacatggagaaaccctgtctctaccaaaaatacaaaaattagccaggcatggtggtggacgcctgtagtcccagctactcggaggctgaggcaggagaatcgcttgaacccgggaggtggaggttgcagtgagctgagatcgtgccactgcactccagcctggcaacagagactctgtctcaaaaaaaacgaaactcacttgctaaggcttgatgagaccctgctttggccaggctctgtgctgggcccaggaaggcagtggtgaccacaacccctgccatggtaaatctcagtctggtccatcttgcacagctgccattttgggtcacgtctgtaaatacagagaaaagggcctgtggtggttgtattcatttgctagagctgtcataacaaagtaccacaaattgagtggatgaaacaacagaaatgtattctcttattgttctggaagctggaaattcaagattaagatgccctcagggccatgctccctctgaagacactgggaaggatccgttccagacttctctcctccattctggtagttccttggctttgggcagcataactacagccttcacatgaagctctgcctatgtgcatgtctctgttcaaatttcccctctttataagaacaccaatcatactggagtaggggcccaccctactccactatgaccttaactcattacatctgcagtgactttatttggagagttagggttaagtacatgggattgggacttccacatatgaattttgtgaagaacacaattcaacccgtcacagatgtaagttatgcttctctttgcaagacaatatcagcagctggtactggggaatatgagttctctggccctgttggtgggagaagaataggctggcctttgtgaatggaaggttgaaccaaacacatggcttatgaagtggggaaggacaggacctaggttcaaatcccaacctcccatgtaatgaggagaacagctaccattgtttgcacactgattgagccagcaccatgctcaacattttgcatagagcatgttagccataaacctcacagcatgacaactataaagtgcacatcatttgcagtttacagatgaggaaactgagcctcgtagctgctcaaagacacacagcaagaaagtggcaaagccaagatttaaatccaggactgaccctatggcttttccccaccacatttggagccccttttctgaacctgtttccctgtctctaaaattgagctaaaacagagttgtgaggattaaacaagatctcttaccatctggctcatagaacatgcagactaagattttgtttttctcttccccacacctatgcccacagagggtgttgtatgggtggaggctttttcagttgcccttttcagagcaaagtgaccagcccttcctgctctcagcccctgtggctccattacagcagttgtgagctcttgggcacatgcctgaccctccaatactgccacttgaacatgagttttcttttactgagacaggatctcactccattgcctgagctctccagcatgagactgcagtggcacaatcacagcccaccatagcctccacctcccaggctcaggtgatcctcctgcctcagcctcccaagtagctgggactacaggcacatgccaccatgcccggctaatttttttttgtaattttttgtagagatgggctctcactatgttgtccaggctggtcttaaatgcctaggctcaagtgatctgcccaccccagcctcccaaagtgctgggattacaggcatgagccaccacacccagctgaacatgagttttcaaaggatgatatgatccagcactgaagaagcacccatcaaaatagaatgatgtgattgatgcataaatcaacagagataagtggaagattgcaagacagggagagtagatagatgggtagaagcaaggaaagaaagatatatgtaatgaattagatgggtggaaggttggatggatggaaatttggatggataggtggaaggatagatgatggaaggttggatggacaggtttaagaatggatggatgacaggttgtatggataggttgaaatacagatggatggaaaggacaggttgaaataaagatggatggaaagctggatggacaggtagaagtacagatggatggaaggttggatggataagcagaaggatggtcagggagaagattggatggataagtggaaggatggatgatggaaggttagatggataggtggaaggctggatggataggtggaaggctggatggatggaaggttggatggataggtggaaggatggatggatggaaggttggatggataggtggaaggatggatggatggaaggatggatggataggtggaaggatggatgatggaagaacttttttggttttttgtttttgtttaaatatttgcaaatcatttatctgatgaaggatttgtatccagaatatacaaagaactcttaaaagtcaacaaataactcaactgaaaatgagcaaaggatttgaacagacacttctccaaagaaaacacattaatgtgccaatgagcacatgaaaacatgttcagcagcattagctatcaggaaattcaaatgaaaccacaatgagacaccacttcacacccagtagaatagttaaaattttaaacatagatataataataagtgttggtaaggatgcggaagtattggaaccctatacactgctggtaggattgtaaaatggtacagctactttagaaaacagtttggcggttcttctctaaacacagagtaatcatatgacccagcaattctgctcctacatatagatgaaaccctttttcttggggttctaggacgacttggcctgcaggacagagcccggcacgcagggcctttgcgtcttttcccacaagaagcgtggaccatttcgcccatcccagccctactggcttcagtttcccctctatgagagcccgcgggtctccacctgagagaatgcaggtgctcccgcgccgggagtgggcgggcagaagagcgggcggggggcggtccggatgcctcgtcccgccccgccccgcccctttctgccctcctcgggagaaggaggtggcccggtggccctggcggcgcggagactggcgcagcgcggggagcacgcagcgccgcgggagcccgggccaggtgagcgaagcccggacgcgggccagggagggacgcaggtgctggagggacagggagggtgagggagccaagaggggaggggacccccaccctggagctgcccgcgagcccagcgctctcagggtcagtccctgatgctccccacccttttgccagttccttccaccaaacccgcttttggggtccccatcgacctggattccggcggagacactgtctgtgactccatcaaagtttcctcatgttctctgggcctcagtttccacctctgggtaatgggaaccatagcctgtacttcactgaacttccaaaagaatgagtgaagccatgtccagggtgggtctggcgcgcgaccatagcacagccagatcccgaacacgccccagagattttgttcacccagcagcatttgctggccgcctgctttgcgccaggcactgttctaggtgctgggacactccagggaatgaaatcctcctggagctttgcaatctagcctcgcaaggcattctggcgtctgttttctcatgaccaccctgtgaggagccagagcagccagaaatatttgggtccattcgcggttgtgggtactaaggtacagtgaggttttaaggcccttacccaagggcacaccccaataagtgagtatccaaggctgagtccagcctttgccacaaaaggcatcctcttagggtagaaagtcagctctggtcccatagacccttccccagaacagagtcctctgggcctgagtacaggaggagggctcgctgtggggctgcatcctctcctctccctctcggggatttaggcccctgctcatgatggtttgcagtctctctcattaaatccatgagtgggctgggcgcagtggctcacgcctgtaatcccagcactttgggaggctgagggtggcagatcacttgagaccaggagtttgagaccagcctggccaaaatggtgaaacccccgtctctactaaaaatacaaaaattaaccaggtgtggtggcgcgtgcctgtagtcccagctactcgggaggctgagggaggagaattgcttgaacaaggcaggcggaggttgcagtgagccaagatcacaccactgcactccagcctgagcaacagagtgagactccttctctaaataaataaataaagccatgagtgttcgtgcttatacggggcaggactgtattcctcacccagacatttggtgagcagggcagtaacagaggaaattaaaaatacagcccctctagctgccagagtccctgccctgtgaccaccaccagcaaaaaaacatggggctcatcagtccagtcactcaacaaatacccgttctttcatgcagccagtatatgccatgcagggcagagatgcacctatctgtatatgtagggcctggcgcacagaggtccctagcacatggttgctgttgttacggttaatgatcacctagccctggtcatccagcctcatcctcaggtggagagggaggtcgggaggggggtggggggatggacgatggtgacagtgactgacagcctggcttgccctgagtctagactgagggctgggcacagtggctaacgcctgtaatctcaacactttgggaggccaaggcaggagaattgcttgagttccaggagttcactactagcctgggcaacagagtgagactctgtctcaaaaattaaaaaaagatctagggagctggatgcggtggctcacacctgtaatcccagcactttgggaggctgaggtgggaggatcacttgaggtcaggagttcaagaccagcctggccaacatggtgaaaccccatctctactaaaaatgcaaaaattcaccaggcatggtagcatgcacctgtattcccagctgcttgtggggctaagatggaaggatcgcttgagcacagaagtttgaagctgcagtgagctatgattgtgccactgcactccagcctgggcgacagagaaaagaaagtagtctgaggctgcaaagaacaggatcctcagtgctgtccccctaggcccatagaccagaccctaaagcctgcagagggattgggcagaacgtgtggtaccagccacccacactactgtcggaccttggaggaccagaggcgtcaggcatcagggtggagacaggcacagcacttggagtcatgtgcaagtttccagggtgcagagtccttttggatccatgtggattctcctcctcctcctctttctcttcctcctcttccagaaggctctcccaatctccccagtcagaaagcagccacctcccagtctggtgaggttcccgctggatgatttgccctgtcttcctttggtactccatggaaactggaattttaaggaactggtagataagtcaggaatgcttaatgtcaacctcagttacacagcgtgactttgggcctcaattttcttagctctaaaatccaagtcttggctgccttgtctctgactctgtgcagaggacagcagccacactggagttttttgtttgtttgtttgtttgtttgtttttgagactgagtctcattctattgcccagactggggtgcagtggcaccatctcagctcactgcaacctccgccttccaggttcaagcaattcttgtgcttcagtctcctgagtagctgggattacaggtgtgccccactacacccggctaatttttgtattttcagtagagacaggatttcaccatgttggccatgctgatctccaactcctggcctcaagtgatccgcccacctcagcctcccaaactgctgggattacagacgtgaaccaccacgccgggcccacactggagattcttgagattctgaaaggggcaggttccctgggaactcagagaatttctaatttccacctggagttcccctcagtcctagaggtctaataatttatgtgacttgaaacgattctagagcattctttcttctattttttttcccacaggtggtcggtttctgggtctgcatggctcagtagaggatgaagtccaaccccccacgctcctccctagaggcctgcaaagctgcaggccagggtgagaagagctgccctgtctgccaggcctgtggagaggtctcaggtccaaggtctggctcagggtctgagtcaaggcctgcaccaaagcctggtgccattccagggcctggactggggcccaaagctattccaggacctcaggcgggttctggtactgttccgaggcctggtgctatttcagggactggaccaggtctagggcctgggccaggagctgggtctgtacctgggccaggagctgggtccgtacctggtctaggagctaggtccgtacctgggccaggagctgggtccgtacctgggccaggagctgggtccgtacctgggccaggagctgggtctgtacctggaccaggagctgggtcgggacctggtctaggaggtgggttgggacctggtgtaggagctgggccaggagctgggtctgtacctgggccgggagctggatcggtacctgggccgggagctggatcggtacctgggccgggagctggatcagtacctggggcaggagctgggtctacacctgagccagagctagggcctgggctcagacaggggtctgggactgggcccagacccagtgagtcaacaacaaccccaacaccagcgccgcagcagaagactcaagccaaacctacaaaggctgccaggcagaaggttctagtgactggaggaggaggctacctgggcttcagcctgggatcccacctagccaagagcggcacttccgtcattctgcttgaccgccgcagaccccagtgggaactgtccccggaaaccaagttcatccaggtacaaggaacaagggtcttaatagactggggcagtggtgatggtcaggggacagtgtttgatgtgaaacctgtggtgtggagtttaggggcacactgtttgaagccagactgtttgagctatagctctggctctggtgctaccagctgggtagctatggtcacagaaaggggacaatagtaaccaacacctacttcacagggtctcattgggagttgatgagacagtgcacataaacctagcacagcccctgtcacctacagagcgtgatgaatgagcacgggatgttgctcacggtgccctgtagaatcatttagtgaatcctgccccaccagcctttcctgatgctacagaggcttggcctgggctgggtcagggggccagttctgagaccaggcaaggtgcagaggtgttatctcttgccttggacttgaaccccctgccctcatctcttcttcctctggtgcaggctgatgtccgagatgaagaagccctgtaccgtgccttcgaaggggtggactgtgtcttccacgtggcttcctatggaatgtccggggctgagaaggtgggctcctcacacacaacacctggagttagacagagtggggttccagtcctggctctgccctcacacccatgcattccctatcatgcttcacctattataggagggacttgggctactcccaccctgcatcctgcatccatgacaccaaataccagttctgccattttttttttttttttttttttttttttttttttttttgagactgagtctcactctgtcacccaggctggagtgcagtggcacaatctcagctcactgcaacttccatctcccaggttcaagtggttcttctgcctcagcctcctgagtagctgggattacaggtgccaccaacacgcccagctaatttttgtatttttagtagaaacagggtttcaccatgttggccaggctggtctcaagctcctgacctcaggtgatctgcccgccttggcctcccaaagtgctgggattacaggcaggagccaccgcacccggccccatttctgccattttataactgtgttatctagggcaagtttatttaacctctttgatcctctttcatcatctggaaagtgaggatattactattggtaatatcacaacctcttcagagagcaatgtaatagtatccaccaaaacatatgtatacccgttgcctcagaaattacactcatttgtgtatttgcagcattgtttttaataacaaaacaccagaaataacctatcagttgaggactatttaaataaattgtgttttacagtcaaattctatgcagccattcaaaagaaagaggtaactcaaagtgtgcagattaaaaaaatagtttccaaggtgcaaagcagtgtttggcattctcctgtttgtttccaaaaaaagctaaagaaactatttatttctatagtcacacatgcttatatgctgatattaataagaatagattatctcgagaaacaccggaaatttaacagtggctgcctctggggagggaaaaggaagatttggaatcaggagtaggagggaaccttctttttcactatacacccattttactgtttgaattctttttaaccttgatcgtgttgcctatgaaacaaaaacagccacaacaagaataaatatagagccaggtgtggtggctcacacctgtaatcccagcactttgggaggccaaggtgggaggattgcttgagcccaggagttcgagaccagcctgggcaacatagtgagacccctatctctatttaaaaataataaaagtaaattttattatttttatttatttatttatttttgagacggagtttcgctcagtcaccaaggctggtgtgcagtgatatgatctcagctcactgcagcctccacctcccaggctcaagcgattcttctgcctcagactcctgagtagctaagattacagttgcacgccaccacacctggctaatttttgtatttttagtagagatggggttttgccatgttgctcaagctggtctcaaactcctgacctgaagtgatccgcccacctcggcctcccaaagtgctgggattacaggcatgagataccacacctggccaaaaatttttaaaagaataaatataggctggaagcagtggctcatgcctgtacccccaacatttggagaggccaaggcaggtggatcacctgaggtcaggagtttgagaccatcctgaccaacatgatgaaaccccatctctactaaatacaaaaacattagccaggcatggtggtgcatgcctgtaatcccagctacttgggaggctgaggcaggagaatcattcaaacccgggaggcagaggttgcagtgagccaagattgtaccactacactccaccttggacaacaagagctaaactcggtctcaaaaaaataataataataaatatagcttaaaaataagcatggagctcatctcctggtgtgatgagaattaaatgagatcatggatcaggaagttcttgccctgttcctggcccacaggagccctcacagcggcctaatttttgtttttcacatcccagctccctcgtgagggcccagcccatattaccatgttcaccttacagatagggaaactgaggctttgagagtaggaaaatgacccaacaggttctgagcccatcttctgtgccaggcactgtaccaggtcctctcaagtgtcttattgagtcccgcccaccacccaggggaggaggttggccctcactttacaaatgaggttgctgagggacagatgtgtgggcagaacctcctctggccacccaggaagatggtggcagagccaggcacccacactccaggtgggccttcgggatccctgcctctgaactgaacatcctgctgccctgtcccacctgaccccaagctcagccttccagcctcagcaagaaggcatgggtagcaccatgactttctcacctgtcttgtcttttagctgcagaaagagcagattgagtctataaatgttggaggcaccaaactagtgattgatggtaggtgctcagagccgggtatgacctgctgtgcctctccccctctctcccttctcctgctgcaggcctggctcccagggtgtagggtcaaagggagggcctgtgggcagcgcatccttcgtgcactgcagacctccccagggccctgcatgggtgtgtcagtgtggccttagcatgtctgggaacatggggaccagagttacctctcagggcttagggactggaaaaagaaaagttgccgaagctggctgggcgtggtggctcatgcctgtaatcccagcactttgggagaccaacaggggtggatcacctgaggtcaagagttcgagaccagcctggccaaaatggtgaaaccccacctctactaaaaatacaaaaaattagccaggcgtggtggcgggtgcctgcagtcccacctacctaggaggctgaggcaggagaatcgcttgaatctgagaggcagaggttgcagtgagccgagatcgtgccactgctctacagcctgggtaacaagagcaaaactccatctcaaaataaataaataaataaaatttaaaaataaataaataagtctgggcgaggtggctcacgcctgtaatcccagcactttgggaggccgaggcaggtggatcacctgaggtcgggagttcggggctagactgaccaacacgaagagatcccatctctactaaaactacaaaattagcggggcgtggtggcgcatgcctgtaatcccagctactcgggaggctgaggcaggagaatcgcttgaacctgggagggggaagttgtggtgagccgagatcgcgccattgcactccagcctgggcaacaagagtgaaactccgtctcaataaataaataaataaataaataaacaaacagataaataaaaagttactaaagcaccaaaatcgcagacccatgtgtgggctgcctgggcatgtcctgccttatcccgtatgtctttgattctagagtgtctttttctaagtctccatccagtgagaccttcttctgacctgtctctggcaaggtagcccaggggtccaagccacaatgagaaagaataaggagcagacctggctcccaggggcccacagagcaggaacttgacctgcaccctaagttaagggcaggagactcttccctcctgaacagctgtagattctgggagggtcctgggggtccaagttgtgtgttgaaaacttggtagagatctgcatgacacctcctcagccgactctatgctcacttgtgtcccgtgtgtgtctgtgtctttgcatgtgtgtgtgtgtttatttgttgctatgtgcacctgctgctgcagtctgtgttcgccggcgggttccaaggctcatctataccagcactgtcaatgttgcatttggagggaagcccatagagcagggcgatgaggactctgtgccatatttcccattggacgaggtacctgtcttccgggagaggtgggcaggacccgcgggcccgggacccacagctcagaggggagggatgggtggaagcagggttggtttcacaactcaggatacgtcctagcaggaaggggctcccaaaactgggtggcgtcagcactctcctgtttcagttggtcacacctgcaggggcattgaaatcagacaggtctggccttagcctcaacctggccgcattctacccatgtgaccctgaccctgagcaaatcacttaagccctttgagcctgtttttttttcttttcttttcttttgtttttttgagacagagtctcaccctgtccccaggctggagtgcagtggcgtgattttggctcactgcaacctctgcctcctgggttcaatagattctcctgcctcagcctcccaagtagctgggattataggtgcatgccaccacaaccagccaatttttgtatttttagtagagacagggtttaccatgttggccaggatggtctccatctcttgacctcgtgatctgccagcctcagcctcccaaagtgctgggattacaggcgtgttgtttgtttgttttgttttgttttgagacaaggtcttgctttgctctgtcactcagactggagtgcagtgtcatgatctcagctcactgcaacctctgcctcccgggttcaagtgattctcctgcctcagcctccccagtagctgggactacagtcgtgcgccaccacgcccagctaatttttgtatttttagtggatacaggtttcattgagttgcccaggctggtctcgaactcctgggctcaatcaatcctccctcctgcggctgtcaaagtgctggaattacaggcatgagccactgcacccggacaagcctctgtttcttcaacccagtatggtaacactatcaccatggggttgtgcagagcaggaaataagataaccgatgtgaaaatgccatgtgaacacaaaagagccatgtgtaggtaattcatccagcatgtgtccagcatcagccttgcaaggacaggtgtctggggctggcaggagcctccctgagtcggctgcccctggtcattgttactgctccgaacccagtgctcctctgctcctgtggctctggaaggagatgcactgttctcccacccagggggagaggaaaggccatggggctcagggcctggccatatcccagtgggagtccccagggaaggtgcagccctggggctgggcaggcattgccagcagcattgctgaccctctctggtggttctgtttttcctggcctctggcagcacgtagaccactactcccgaaccaaagccatcgccgaccaattgaccctcatggccaatgggatgcctctcccaggtgagtatcatggggctctgcttgtaccaaatgcacctgcccactgctgcctcctccaaaatacatgtgtgattcatgctaacatgtgtctgaggcccaccttccttccaaaggacggtttcccagggccttgcccattcatcattcagcacattctgagcacctgctgtgtggctgcaccccaccagggatacagcccagaagaagtcaggcccagtgtctgcccttacatagctcacagctaggtggggaagagacttgagcaaacccaagtctctctcttttctcctgcacaggagttgatccagttttaggggccctctttagacaaaagagtaccaaattatgagtgtggaatgagatataacactttggaagggcctggcaagggagaggcccaaaagctcaagcttcagcaacttcccagtagagtctaccttggctgtcttagttatttatttgttttagagatagggtcttgctctgttgcccaggctggagtgcaatggcacaatcatagcttactgcagcctcaaactcctgggcttaagtaatcctcctgcctcagcctcccaagtggctgaaactgcaggtgtgtgccaccattccaggcttattttaaatttttttgtagagatggggtctcactatgtcatccaggctggtctcaaactcctggcctcaagtgatcttcctgcctcgaactcccaaatgctgggattacaggcatgagccaccatgcctggccttggctgcctttttatattgcctcttctggttatagatgagtaatagtagaaggcaaatagtccgtatttcttgagtgcacactacatgccaggccctattttgcatgctatttttttctttcaaatacaattattaatctcttatttttttttctttgagaaggagtattgctctgtcacccaggctgcagtgaaatggtgtgattttggctcactgcaacctctgcctcctgggttcaatagattctcctgcctcggcctcccgaatagctgggactacaggtgcatgccaccacacctggctaatttttgtatttttagtagagatggggtttcaccatgttggtcaggctagtctagaactgctgacctcaagcgatccacctgccttggcctcccaaagtgctgggattataggcatgggagtctgtgagccaccacacctggccccattctttattctacttttccctttattttaattttatctcatttttttatggattctcctcccacaggttgctaactttatatgcaaaggtctgattaacccttcacagtaccccttttaggtaaaaaccatagatatcccttgctttctaagcttcagaaccaaatttattcaaataaatttcgtgctatccaaattatcactatttgggccggtacagtggctcacgcctgtaatctcagcactttgggaggcggaggtgggtggatggcttgagtttaggagttcgagaccagcctggagaacatggcaaaaccatgtctgtacaaaatatatatatatgtatatgggctacgtatatatatgtgtgtgtgtatatatatatatatatatatatagctttctaaaattcagaacgtaaaaagaatcagataacttggtttcccttcactatcaaaactatctaaacttgagagccaggtggatttggagagtcggaggcttaaaaattataatcctcactgggtgcggtggctcacacttgtaatcccagcactttgggaggctgaggcgggcggatcacaaggtcaggagttcaagaccagcctagccaatatggtgaaaccccgtctctactaaaaatacaaaaaaattagctgggcatggcaatgcgtccctgtaatcccagctactcaggaggctgaggcaggagaatcccttgaacccagggagcagaggttgcagtgagccgagattgtgccactacactccagcctgggagacagagcgagactccatctcaataataataataataatcctcaatgtacaggtgagaaaacagacagatgaactgacctcactcaagatcatccagctgttaggtggtagaggtgggatttgaaccccaggagagtttaacaccagagcctggggcctaatcactgtgcagtgctgcagccccagctgagcaggtccctgagcatcaactcttttccctaaaatcttccccacccccagcccccaccctactccccatcaccctgggccagttaggcctggacccctgattccagtagaaatatccagctgttctcccaggagtttcaaccttgtgcagttgaataatattttctctacctggggcctctgccagccagcccagtagcctgtactctagacacctaatcctccagccaagaattatttatatgagcatctgcagctttccatggtcaggagagtcatggataccctggccctccgtgaagtagctgttcaatgccccgcctgccaacgtcagctgcaacccgacctccccccactatgcccaggtgacccagagtttaaaattagctgcaagctgtttacaggaaatctcacccaatatctgccttccaggagtcccgctgcagtcacctggggtcatttccactccctactatccaagcgggttcctgaaactgttcttctgactcggcgcagaggtccgtagtcctgggagcagagtcctgaggcgtgcagatcctagctcagtgttaatgcagttatgtcctcccgtcttctgtctctgggtgtgttagtatcctgtggcagctgtgacaaatgatgccacccaaacttgatggcttaaaacaatagaaatgggccgggcatggtggctgacacctgtaatcccagcactttgtgaggccaagacgggaggactgcttgagctcaggagttcaagaccagcccgggcaacatggcaaaactccatctctacaaaaaaatacaaaaatgacctggtgtggtggtgcacacctgtactcccagctactcgggaggcagaggtgggaggatcacctgagcccagggaggtcaagatggcagtaagctgtgaccctctctcaaaaacaaatgaacaaaagacaatcgtttcttctctcaccatcctggaggccagagtctgaaatcaaggtgtctgctgggctgtactcccagaggctcaagtaggctacactccttccttttttttttttttttttagtctcccaaccacttgggagactaaggtaggatgattgcttgagcctgggaggttgaggatgcagtgagccatgacgcaccactgcatttcagcctgggtgacagagtgagaccctgtctctaaaaataattaattaaataagtcattttaggctgggcacagtggcttacgcctgtaatcccagcactttgggaggctgaggtgggtggatcacctgaggtcaggcattcaagaccagcctggccaacatagcgaagcccctcctctactaaaaatacaaaaattagtggggcgtggtggcaggtgcctgtaatcccagctactcgggaggctgaggcaggcgaatcacttgaacctgacaggtagaggttgcagtgagccgagatcgtgccattgcactccagcctgcgcgacagagcaagactctattaaaaaaaaaaaaaagtcattttaaatattttctaaaactcttttttaaaaatagttatagtgttctatagcactatatagtgactataattaacaactatttattgtgtattttcaaatagctagaagagtggattttttttctttgggacagggtctcgctctgtcgcccaggctgaagtgtagtggcgctatcatggctcactgcagcctcaaagtcttggattcaagtgattcccccaccccagcctccaagaacattgggcctgtaggtgcacaccatggtgcctggctaattttttttttctttgtcagagatgggggtctcgttttattgcccaggcagtagatgtgaatgttcccaagacaaagaaatgtattaatagatatgctcattaccctgatttgatcattacacactgtatgcatgtaggtaaaaaccttaggtatcccttacgctctaaacttcagagccaaaacatcacaccttaccccacaaatatgtacaattattatatggcaataaaaataaaagaaaaattttttaaatcttaaacatgaattatgaggataaactgaatactttgtaggtgttattttattttattttttaataaatagtagagactcactatgttgcccaggctggtctcgaactcctgggctcaagcaatcctcctgccttggcctcccaaagtgctgggattacaggcgtgagccactgctcccagctagtagtaggtgttcttaagacaagactgacatatgtctgtggcagcccttcagactgtaaccccagaccgccccaggagatacatgttcacctgcttctgccatttgggtccctccagtggagaatttgggaagccctagattgagctctgtcagggtctggggaactccgctgagatagagcagtgaaaggggtacagaccccggctctttcctttctccattgattggaaagtgtagcagctgctgccacttccaaagcacccattttccatgtgaggaaaccaaggctgagctggctaaaagacagggttcactgtttgccttactgctgagaagcggaggtattagtggaaacggtgtggacttcaggtccccatctcagctccactgcgctgatctgtgtgactggaagcaaatcacatcccttctctgagctgtggttcttttatccataggcagggattataacatctccaaccttggcgtatcagagcaccaggaacatagaaggacctctctgagagtccttgtctcttagatatctattatatagtccttatctatacataaggacctctcctggtccttatccaactgctgattagaaaaagggagaacaaggccgggcgcggtggctcatgcctgtaatactagcacttcaggaggccaaggcgggtggatcacctggggtcaggagttcaagaccagcctggccaacatggtgaaaccccgtctctactaaaaaatacaaaaattagctgggcatggttgtgggcacctgtaatcccagctacttgggaggctaaggcaggaaaattgcttgaacccgggagatggaggttgcagtgagccaagattgcgccactgcattgcagcctgggcggcagagcaagattccatctcaaaaaaaaagaaataaagaaagaaaaagaaaaaggaaaaggaaaaggaaaaagagagaccaagagctatgggcatgagggcatgtgcatctatgtgcatctgtaaaatgggcacagtagtactctcaaggggcatcaaagaaaatcactctgccgagtgcttggtaaacagaccggccgtgcagatgtttgcatctggctcttacctttgtgactgcactgtgagcaatgggagggcagggaccatttattggtcatccttacattcttcacaggatccatccagggtggggggcagggggattggaggtgggagtgagactctgaatagtgtctgttgaatgactgactaagagaataataaattgaacgaggaagcccctgggccggtcttcccctctagcctgtccaggtaagcaccaacagatggaggtggcctctctctccctctccctgtgggctgctcctcccctgacccctgaccacgcttccctgtgtgctaggaggaggcactcttcggacgtgtgtgctccggcctccagggatctacggccctgaagagcagaggcacctgccccgtgtggcggtacgtcatccccgccttcaggacccaagtcagagaaggatcctggctgaggtgtacactggtcgggccctcccagcccctggtcgctgcatcagtctcgaggctaagtgtcctgagcctggaaccctcagttctacaagatgttcctgcccccactggtccacaggccccttggagctcctggcaggaacagagctctcagagtgtaccagccaagccaaggcacgggtagaggagccatagagctgtgaccccaaaaaggcagaagagagcctgttgccctcactcccatgtgggctccctgaagcctggatggtttattccatgctgagagcacaagtgtcttcatacagaaagcctctaaagggtcgggtgccagaaatacagctacaaggggctataggccctgtcctcgaatttctcagggagacagacaccacagtcacagcttcaatgtggggagggctgtggagagaggagcacaagaagatgggcctggcaggggaaacccaggagggctccctggaggaagtgatgtctgtgttgtttgaaaaaagaaaaaggaattaaccaaggaaatgaagtggtagagagaagataggccaaacagaggggacagcttgggcacaaacctggaagtgagaaaggtcatgattgttttaggaagcagcaagaggtccctgtggctggatctgatctgggagtacgggattatgaggagctagagttattggcggggagaagttccagtctgcagtttcagaacattcctctgcttggctatatgtctttttgtttatagtcagggtctcactgtatcacccaggcaagagtgcaatggtgtgatcatggctcactgcagcctccacctcctggactcaagcgatcctcctgccttctgagtaggtgtgactataagtgtgcacaaccatgcctgattgactatttttattttttgtagagatagggtctccttatgttgcccaagctgatctcaaattcctggcctcaaccaatcctcctgcctcaacctcccaagttgctgggatgacaggcgtgaactactggacccagcaatcattttttttcttttgagttaactgggttcttaaggaatgtggtcaaccccagtgactctctccccattcatttattcattcattcaacgaatacttacgaactcctagtatgtgccccgcactgttctaggtttgaggacagatcagtgaacaaaacagatgattcctgtccttgtggcgtttatcttctcatatgaagagacagataatgaacatgttaaattataaggtatgttcaggccaagtgcggtggctcatgcctgtaatcccagcactttgggaggccgacagggatggatcaattgaggtcaggagttcgagaccagcctggccagcatggtgaaaccctgtctctactaaaaatacaaaaaattagccagacgtggtggtgggcacctgtaatcccagatacgcaggaggctgaggcaggagaatcgcttgaacctgggatggggaggttgcagtgagccgagattgtgccattgcactccagcctgggcaacaaaagcgaaacttcatctcaaaaaaaaaaaaaaaaagaagattccaggcactgtggagaaaaggaaaaagcgaggtagggtgagggaattgggcttgtcaggtagtcacgggggggctcatttagaaagggacatttgagcatccacttgacagaggtgacaaagtctgaaaggctcttcctccaaataccttccagacagtgggaacagctcatccaaagccctgagatgggaacctgcagcagtgtccaggaagagcaaaggggcggtgcagctgtggtggagcgagtgagggggtttggtaggagatgaagtcacagaggagctggggccagatcaggaagggtttgacagccattgtcaggacttcagcttccagcctagcaggatgggagcccctggaaggttctgagccgtggaacaacatggttgtacttagaatttttaaaggtcctcctggctgggcatgggagcacatgcctataatctcagcattttgggaggctgagatgggaagatcccttgagcccaggatttcaaggcagcagtgagctatgattgcaccactgcactccagcctgggtgacacagggagactctatctctaaaaataaaaggatccctggctgagcacgctggctcatgtctgtaatcccagcactttgggaagccgaggagggaagattggttgagcccaggagttcaaggccagcctgggcaacatagtgagatccccatttctacaaaaaaatttaaaaagtatccaggtgtggtggtattcatctatagtcccagctactcgggaggccaaggcaggaggatcgcttgagcccgggagttcaaggctgcagtgattgcaccactgaactctagtgtgggcaacagagcccgaccctgtctctaaaaaactatgaaagaatcaaaggatctggcccggcatggtggctcacacctataatcccagcactttgggaggccgagatgggtggatcacctgaggtcaggagtttgagaccagcctggccaacatggtgaaaccctgtctctactaaaaatacaaaaattagctgagcatggtggtttgtgcctgtaattctagctcctcaggaggctgaggcaggagaattgcatgaacccaggggatggagtttgcagtgaccaagatcttgccactgcactccaatctggataacagagcaagaatctgtctcaaaaaaaagaaacaatcaaaggatctgcctggctgggcagagaacagactacaggggctgagggtggacagagggggaccagttaggaagcaactgtggcgtccaggtgagaggagggtggctgtcagagtagcgagaagctatcagattctggacagattttaacagttgaaccaattggatttgcaggtgggttggacatggcgtttaagacaagggggagtcaaaggtggctttagggttttaacctgagtggtagagtgaactgactggtccactgggaagggagggaggagcggggtgggagagacgatcagatgctcgctccaggagctggtgagtttgagttttctgttagacaacccgttgctgatattcagagagcattggatacatgagcctggagcagaggggcctgacctggagctagaacctggggagtcatcagcatctagacggaatgtaaagccacaccggacacaagcctgtttatcacccactcctctccaccagggccacatcaagaagaggctgttcatgttccgatttggggaccacaaggcacggatgaactgggtccacgtacacaatctggtgcaggcacacgtgctggcggccgaggccctcaccacggccaagggctacgtggctgtgagtcccctctgatgcccccaaccaccttccccacagggctgcaggcagagcgtcccatccctaggggatttctggatggcacacaagatttccctccaacttaagaaggctggtgggactctcagcccaggggagcttgggggaagcaggtaggtggggtgtggagttctttatagagcatctttagctcttctctatggccatgtgaggttggcgttgttgatcccagaataacagctgccagatgctaagcctccacacatattgtcgcatttaatcttcacagtagtccaagaaggagatcccattattatcctcccatttctcagatgaagaaactgaagtacagagaggttaagcaactccatggaggtcacacagctagtcagtgtggtcgtcctggaattcacagggaatagttcacgtgtgtcctcaggtattggagctgctccagagaactcagggttggagcagctgctgggagccatctggaagggtggggcaggctgctggggagaaggctgaccgtcccctcccacatgtccccttcagagtgggcaggcgtactacatcaacgatggggagagcgtcaacctctttgagtggatggccccactggtaggtgcacagatgcccacccaccccgaatgatcattctgggatccctgaccttctcttcctttttatttttttttttaattttttgagacagagttttgctcttgtcacccaggctggagtccagtggtacaatctcagctcactgcaacctcccctcccaggttcaagcaattctcatgcctcagcctcccgagtagctgggattacaggcacacgccaccacgcccagttaattttttgtatttttagtagagatggggtttcaccatgtttgccaggctggtctcaaacccctgacctcaagtgatccacccacctcgacctcccagagtgctgggattacaggcatgagccactgtgctcggcctgcggccttctcttcttgtccttttcgatttccaaaaagccagaagatttcacgtcaaaaaccaactctttgcccagtgaggtggctcacatctgtaagcccagcactttgggaggctaacacgggaggatcgcttgaggccaggagtttgagaccaacctgggcaacaaagcgaggacccctgtctctgcaaaaataaaaattcaactaggcaggcatggtgttggcacacctgtggtcccagctacttgggcagctgaggcgggaggatctcttgagcccaggagttcaaggctgcagtgagctatgattgcaccactgcactccagcctgggtaacagaataagaccctatctctaaaaatcaatttttttaaaaaaacacctctggcaacattggaactggctggagcccttgaggggcgccatgtgttcctcagttacctgcagttcccttccaccctgcttccaggcgtttgttttgtttcatttttttgagacagtctcactctgtcacccaggctggagtgcagtggtgcgatctcagctcactgcaacctctgcctcctgggttcaagcgattctcctgccgcagcctcctgatagctgagattacaggtgcacaccaccctgctcggctaattttttgtatttggctaattttcgtatttttagtagagacagggtttcaccatgttggccaggctgatctcgatgcttccagatttatgttggcttctagccctgtggagttttgcttgtgagccacccattatgtgttgaggctcggaaggaggcatgtggaagagacaaaagcgcaagggaggtgtttggctttggggcctccccacacggcagcccgggaactctggtgtcctctctgagcagcccagactcctagcagccaggcttgcctggaaggggtagaccagaaaacccaggctaaaggacacaggtttcctcttgacctggaaagtttttatgccagtgaagagttcaccttatcccatgccagcccatttctgctgcatatcctaccaccctccacagaaaagtcaattctggaaaaatcagattctacataaatgccttagagtgtctctaggtatagacagatgtaggtgataattaaatgatgtgaatgatcccaagttaaaaagctacctggcgggtgtaatggcttatgcctgtaatcccagcacttttgggaggctgaggcaggaggatcacatgaggccaggagttcaagaccagcctgagcaacacatcaagacccctgattctctgcaaaaaaaaaaaaaaaaaattttaactaacccatgctttcaattcctccttgggttttctgggtcaaggtgcggatttcatttcaatactggcacaggcctggggttggctgcagggtctgccccctggggtgggttggtggggagacaggaggtacctctgctggtccccggtagagggagcatgtggtctttccacaccagcccctgaaccacttgttctcactccaggtcgtgtttctttgcagtttgagaagctggggtacagccagccctggatccaggtgcctacttcctgggtttacctgacaggtaaggaaaggagtgtgcgtagtaaagccctccatgtgccaggtgtaccttgcattgccttaattgaaactcaggggccaggcacggtggctcacgcctgtaatcctagcactttgggaggctgaggcaggcagatcacctgagatcagcagttccagaccagtctggccaacacagtgaaaccccatctctactaaaaatacaaaaatcagccgggtgtggtggcgcacgcctgtattcccagctccctgggaggctgaggcaggagaattgctgtaacccaggaggcagaggttgcagtgagccgagatcccgccactgcactccagactgggtgacagagtgagactctgtctcaaaagaaaaacaagaaaagaaaaagaaactcaggcaggaccaggactagggtgaggacagtgaggcactgtggtcacaaaatttaaggaggccacgcagcagctccaagcctgagtttgcacttgtctggtgccggaagcaagtgcctccttaaattccacaccctaggtgtctcacttccctcaccctagtcccacctgcaaggcagctatgatgggcccattgtaaagatgaggtgacccgaggctctgagaggttagtgactttctcaaagtgccacagtgagaatgcgggagaggcggagaggcggaattcacaactgggcttggtgggctctttgtggtgctgctgggaggtctcatgccagtcaggaggagagagaaccctggggctgttctgtcccccaaggtcaccctgaagttagggctactttaggacaaacggaggctccattttgatcctagattctcctcctgtccctgaaggtcagtctctgctcccacctccacccccgacaatgcgtcttggctgctccccttccctctgtccccagcacccatacaatggcctcctcccagctggaaggcagagcagccttcagacatggagtgaccagcctgaggggatggtggccctccagtcccaaatagctgtgttccagggactccttggcaggatctcttgtgttttaaatgcatcgagtggcttgccattaaaagcagggggttgcaaatttttgttcaccagggaacacatgcagggcaacttctcatgcacagcattgccgcagtgattggtactcccggccctgagccacggccgatggcacttggagaggattgtaaaggcgttcccagttcccagtgggctaacagtaattcagtgcttctcaaccagggctgcactgcacagtcacctgggagcttttaaaatagagaaatgtctcagccacactaccgaccaattaaattgggattagcagggaggaagtgggaggaaagcatcagtattttttatttttttagagttagggtcttgcactgccacccaggctggagtgcagtggcatgatcataactcactgcagactcaacctcctgggctcaagcaattctctgcctcagcctctcaagcctctaggactacaggctcctaccaccaggcccagctaatttttatactttagtagagatgggggtcttgctatgttaccccagctggtatcgaactcctggcctgaagcgatcctcccacttcagcctccagagtagtggaggtaacaggcatgcacctccatgcctggctattttcaaaaattttttagagatgagggcgtctcactttgttgtctaggctggtcttgaactcctggctccaagagatcctccctcctcagtctcttatgctgggattacaggcatgagccaccacacctggttctcacaagtattatttttaaattggtcccacatgcagcccagtttgagaactgttactccaacctctttctctcctactccagagagcattggagtagaagtgagagagagattattatatggataactttgaatctgttcagatttatttaaaaacttcagtcgttcaattttttttttttttctgacggagtcttattatgttgcccagcctggagtgcagtggtgcaatctcagctcactgcaatctctgcgtcctgggtacaagcgattctcctgcctcagcctccccagtagctgggattacaggcatgtgccaccacgcccggctaatttttgtatttgtagtagagacagggtttcaccatgttgaccagcctggtctcgaactcctgatctcaggcaatccgcccgcctcagcctcccaaagtgctgggattacaggcttgagccactgcacccagcctggtcatttaatattaaaaacaagttacttgtgacatatttcacagctaaacaaggcaccccagcaagggctgctgatttaaaggaatccagtgacttctgcaaagtgacctctagcaaagcaaatggtgtcccccattgatttgtccccaagggcctccctggagtttgcataatgtgaggcccctggtcactggccccctccttccctgcagcagcagttatggagcgcctccatctggccctgagacccatctgcagcctcccaccgctgctcactcgtagtgaggtaagtgggctgctgttatgggacctaggccctgctccccatccctcccttcctacctctccccaccatccccactgctgccactccttacccctttgacaccatgatgacacatgcttgtctgaagtctcagaactttccatgtgggcccaaagctggtgctagctctgttatgatcaccccaacctctgggcttttgctgaggctgtgctttctgggtctgaaatgtgacagctccaagcctatccatcatcactgtttcttcattcataagcatcttgtctttccagccagactggaggttcccaaaggcaagtttcaggccattcacttctttgaatgctaccaatcccaccaactctcaacacatacatacacacacacaacagcctggtggtcctaggctcatagttcatgcttactgaataatgagtatatattaagtacctactacatacagaatataattatttttatgagacagggtctcactatattgtccaggctggtttcaaactcctgagctcaagagatcctcttggccaggtgtggtggctcgcacctataatcccagtgctttgggaggctgagacaggaggatcacttgaggccaggagtttgagaccagcctgggcaacatagcaagacctcatctctacaaaaaattttaaaattagccaggcaaggtggtgcatgcctttagtcccagctcaggtgggggattacttgagcccaggagttcaaggctgcagattgcaccactgtactccagcctaggcaacagatggagatcctgcccctaaaaaccaaaaaaaaaaaaaaagattctcccccctcagccttctaaatagctgagattacaggcatgcaccaccatgcctggctcagaatactattctcataataatgatgatgcaggtttatatttgcttagttaaaagagaggatgttttcatcacagattgtaaatagcaaagtaatcggtggtatttgaggttatttgcaaaaatccttccagtccagtcgggcacggtggctcacacttgttcccagcactttgggaggctgaggcgggtggataacctgaggtcaggagtttgagaccagcctggccaacgcagtgaaatcctgtctctactaaaaatacaaaaattagctgggtgtggtggcacatacctgtagtcccagctactcgggatgctgaggcagaagagtcgcttgaacctggaaggtggaggttgcagtgtgctgagaccacaccattgtactccagcctgggtgacagcacaagactccatctaaaaaaaaaaaaaaaattacttccagtccactctcgttttattgtctctgatgccctgctaagttaaaaaggtcaaaaaaaaatcgtgatctccattttatgatgaaaaattgagcactaggaaaattatttgtccaaggccacaccatactggaattggcttcagactccatgttcagtgctctttaacaaggggagtcagagggggagagtggagaatgggccacagaaagaagtagtcacctatggcttctcctttgagccatccggatcagtggaggagagaataagatgatactgacaatctcttgagttgtgacagtatgccaggcactgtgctttatctcatttaactgagttgtagacaacattgtcctctccatttagagaggaggaaatgagacacacagtgaaataacctgcccgtgatcactcacttaaatggtagagctgggatttgaacccagacctcagtgatttcaagcttaaccattagcttgtgaaaatgcatcaggaatcacatccacataaaatagctgccagggtgcagctgaattgtggtcaggcagggacttggctcctctccctcttgtttaacttggggatttccttgttcagctcaggggcaatgtccttaactgtggaagttccttggctgtggctcgggtaccctctgctggtcaatctgtgacacatcaaccagccctccagtttgactttatagccttttatgcatttaacataaatgttaccaggcactgtgctgagcaacggaggcaagaagacatagtccttgcccttagggagctcctagttcaaaggggaagacagcccactaaccaggcaactcaacactgtaattagagccattcttgggaaaatcgcgagaaactccagtgcacacagaaggggcgcctcagccaactctgaggaagtcagagaaagcttcccagaggtgacatctagagacatctaggtgtattagggaccctgcttatctagcgtaactcaactcctgtgctccccaaagccctgcacttactgactaggaaaaaaagggacaaatactggcctctctcctcaccccccattaagcatccaagaccacaggtttgaccccaggggctgtttcaatgccatgggagaatccagcagctggtggattcttccccagggtccggctgaggaaaaagagaggaagaaatgagtcaggtgggagaacatctccaggtgccagcacagcagagaagaaattaggctagaacctggctcccctgtgcgaccccaggcaagtcactcaacctctctgacctttttccaagtatgcacagaacagatagtgctagtaccacctgagaggattaaatgaggtagggcatagaaaggatttagtccaggccaaatgcagggtgtgtgttccttaactgctgatagctatcattactacccttcaaaccagtgggccccaagccatctggcagcaggggaaacacagcttagaccctggagagcaatcagttctgcataatcgaattcctctcttagggaagcttagttaataagcgagggcatgaaggctgcgactggggccctcctggtcacagttggtctggggttgggggcaggaagccaaggtcgtttcctgcagatgtttctggcaggcgttcaccttctcctagcggatgcctaagaatgtatcaagggcctcctgagtcccagcaccgtgctaggccgggaagatgagtgtaggggtgagacctttgcttcttagggaccaaggagttaaatagggtgcgaattcagcggggctggagggggcgacgcaaaggcggcaccctccaataaaaatgaacatgtaaggaagaaaggaagacctctctaatgagggcatcgcaggagcaagacgctgcactcgggtccttttaaatcactatgtaatggaggggaaatccctgccctctcttttccctttccgtaaacaacgaagtagaggatgtcctcctcccacgaggcccgccctcggatgccccgcctgtccccgcaggtgcgcagcgtggccgtgacgcacaccttccagatagccaaggcccgcgcccagctcggctacgcgccggataagtttaggttcgccgacgccgtggagctatacgtgcagtccacgacccggcggccccgcggctccacggcgcggaccctcctgcgcctgctgctcaggctgctgctgttcctcggcttgctcgccctggccctgcacttcctaggcctgcagcctctgcacgccgccgtggagcgcctgtgaccgtccgccgtccgccgcccgctagggtcggccccgctgcaccctcgcccacgcccggctccctgggcttgtaccagcccctgccccgccttctgggtttgagcgcgcctccgctccgccccttgaatcctggtcacgcccccgagccgctctccagacctagcccggaccgccgacttctggccacgcccctatctactcccagaccttgccttgcgcccttcctgtgttttggccccgcccctgtcctgtcccgccccgccctccgaagtgggcacgctcctgctccgccccctgaatcctggccacgtccctggtcggcccagacgcgtagccccgagtctctttccatgttttgaccacgcccttgacccgcccttcaaattgggcacgccttcttccccgctcactgatttcctggcctagcccctgagcagacctccagacctagccccgcccccgttttataaccccgcccctgcttcacggcttgggcacgcctcttccccgccccctgacttcagagcctagtcctgagccgctctccaggcctaaccccgccttcatgtcatagccacgccccttcccgcccttccatgtttgggcacgccttctgagtcctggtcacgcctctgtcccgccccctgaatctttcctacgtccatgaccctccctccaggccctggccctgccccttttttcctccctccggcctgtccggtttctgatatgggccaaggctcacagcttcctccgccttctggaccttctcctagtccctgcccagtcccggcccacccccagattctccctcattctggtttcgccccctttctggtcctccccgcgcgcttgagcccaccctttggcttctccttttgggtctgtccttgctcctgcctctggacccggtcccgcccttctcgcgtgtaattgagtcctggccccgccccctccctctctggcttcacccctttccagctccgcctcccgggtaggttctccccggaaccaggctgccgcgtcgctatgggctaacgcaggctcgggtgacgttggtatgagtttgcgccgtcggctgctgctctgtctggtaacattgcattcgatccaccccgacccaatgttctgggcttctcattcacacagatctgtgtgttgacagccagggtttggggaaaaaccgagactcaagcttctgccgagcccgacttggcctttttgggttcctgtctgaggatgacagcatagtaagcacaggttttagtaccagaaagagcatgaaaaatttaaaaaaaaaaactcttaaaataattggatgtctcgatgaagtaccaataaagctataatgggaaaaatagagtttagttggttatattttatgatttagtactgtttctatttattaattagaggtagtggtaatcaccataatctttaaagtttaaggtcacgaaacttctttatctagccctgctctccacagaaacttcgcctcctatcatcttggtatcagttatcagttgtaagtaccaagacatcagtgtgtaaatacaaccatgtatagatcataatatgcacacgtgggactggcagagaagaaaagcaccacaagcctgaggtggatgggatcgaaagggctcatcagaaccaacatggccaccgcagtgtgtgtcccactctgctgaacaaggtgagcagtttgggaaggagctaaaaaaaaatgtatgctcctctctgctaggctgaattttatgtgtgtatataatttttgaaagaataataatcctatgtctgtttaatgcttgacagtgtaaaagagctttcatctatgtgatcttatttaattcttacagctactcttaaatagggtttattactctccttttatagatgacgaaaactggggctttgtctcattccaaagagcagaggagggtgggggtttctgctctacagctgggggaatttggaggagcaccgcctaagccgccactggcctaaacacaacacgtggtaacttctactcttctacactctggccatgccaaggcttgcggttgaactctggtctcgttctctcagagccgcaaacctcggaccatttgaagctggcggtcctggggcttcctttcctctcgataacatgtttacatccaaactcacttccttcctctctttcttctccctgctaatcctgggaaatctgttcttcgagcaggaaaaacaatctcacactgctcacgttattttctagatcttttgactagtgccaaacctacttttgaaaatccaaaagccaagaatcaatttatttgttttctggatttctccaactcatctatttcctaacactctggaagcagaatgtgtaaaccctgggcatggggacaacatggatcgctatgtcaaaaaagcttttttcctttcaagcatctttatccaatggaaaaggaggtggcatccccacccaacaggaaaactgaatcactgtaagaatttttgagactgcccagaccactagcctccatgaggttctgaaagggcaagtaggaggttctagcttacttggagacgctaaagagaagcatcgcaaatgcagaaaacagaattgtcacagtgggcagcccaaggtgacatagtcgatctgaagggattatcaagacaaactcataggctttccattatgggtgctgaagctattcccagttgtaaacccaatgccaggcatctaaaacatcctcaagtctctctcatcttgaaaatatcttcccagcagggcacagtggctcacacctgtaatcccaacattttgggaggctaaggctggaggattgcttgaggtcgggagttcaaaaccaccctgggcgatttggtgagaaccctgcttctacataaaaaaaaattttttttaattagccaggtgtggtggcacccaggaggctgaggcaagagaatcacttgagtccaggagtttgagtctgcagtaagctatgattgcaccactacactccagcctgggcaacagggtgagaccccatctttaaaatttaaaaaaatcctcctttgattcccccattttccctcccacaactgttccttttgctcctccttttcaaaatcaaattttgtgatgaattgaccatacttatgtttccatttcttctcctcaacccattccaaaatggctttcagatcatcaatgatcttgtccataaatcttaatagatatttttccgtctttattttgccaattatcttagctgtgttcagcatagttgactgccccctccttcttgatccgcatttcttggtctctatgaaaccacacctgttttccacgtatattgctggccagtcctttcccgtctctttcgcatctctttcactggcttttcttccactgccctccctttaagatgatgtctctcgggtctctgtcttggcccctcttctccctctgtgggatctttctggatgagttcatcccttcccatggcctcagtctctaatacctcccaaatctgtatcatttccttggagtgctctcttgacctccagaaatctatgtccaacctcctactcaaccccatatcccacaagaatctccagctcaatgaaaatcaaactgaagtcatcatctcccacaaacctgctttccatctatcttgtgttccctcccaggagaggagaggcaccaccagccatccaatgacccaagcccaaatcctgggcgtcacttttgacgtgatcctcttcttctcgacatgctcatctgtggattctgtcaaatctatctctaaaatgtctccctgactcactccttctgtcccgcacccggccactattgtggtacaaaccactgtcctttctcctagacaattgcaataggcattgaatgggacctcctgtccctgctgccagcgggaactttcttttctttctttgtttctttgtttctttctcttttttttgacacggagtttcactcaatcgcccagactggagtgcagtggtgcgatctcggctcactgcaacctccgcctcccaggttcaagcaattctcctgtctcagcctcccaaatagctgggattacaggtgcgtaccaccatgcccagctaaattttgtatttttggtagagacggggtttcaccgtgttggccaggctggtctcaaactcctaacctcaggtgacccacccgcctcagcctcccaaagtgctggaattacaggtgtgagccaccgtgcccaaccagtgaactttctaaattccaaattggaacatgccactctctagctcaaaagccttccatggtttcccattgcccttgggaagggaccaagttcaaagccttaactcggcattcatggccctctttgcctgtctcttcgcctcacctattgccaatactccacctccactctctgtgcagctgccctgaattaccttcacagcgtctcagccttaccaggctctttaggagttccctcttggaaatcccctcccacgccttcacttggctaatctcaatttcaggccccagctaaatgtcacttccttgcttctcaggggccaggttagcatgctgtactgcctaacactcctcacaggtgtaattaattaaaatgacaatgtctgcaaagtcgatgggttcaaaaacatgcctgccttgtacaccaccacagcctcaggacgagcacggtttctggcacatagtaggcccttcataaacagctcaacaactgtttataaatgaaggcccctaaatcaagcctgaaaaccaagtaagaggtgaatcaatgaagcagagacctcaaggttggcacccccacatagggccagacccctactactccagggtcacctgacaacagaggtttatggggtccctggagccctctaaagtacacggagcaggccagaaagggacccccgtccctaactcaggtcatgattacaaccacccccaactaaccccaggaagacccagacaggctgttgggaacttttcaagctagctcagatgctttcccctggaaatggggagatgtgttttgtttttttgttttgttttgagggagctggatgggtaggtgaaagagaggtttgtgtattgggctagacagtgaaagagcctgcactgcagtttctgccttttctcttcccttcccccttccattaaaaaaaatccattataagcaatctaaagctttaaaaaagaaatacatcagaaaggagaaaaaaggaagagaagttggcaaaggactacataaagagatggtttatggatagaaaagtgagaccttctgaggtgtggcagcggtgggattcgaacccacgccatcgaaatgactggagcctaaatccagcgccttagaccactcggccacgctacctcccgatcgtagggcttcctatgccggcatattagtgtgatgacggaggcgccccgccctcaaagtttgcgcatgctcaatatagaaccgctgtctcctgcgttgctcacggagacttggagtcacagtgctctcgcgatcagcagcagtaaacacactaggaacgcactattaaaatgaagagtgcctacatatcaaaaattaatatttttaatattaaatcctcacaagtgtgtttggatttgattttgagttttccttgggcgtgatcctgcctacagccacgtaggggcgctcccgtgctgccgcttcctcccgggtgggccgggatcttgcgtggagccccagtttgtatgttgggtccccaaggtgcagacgctctgtccagttcaaggcccctctgtagccctgagtggcctcatgtcctagcccttgccctcgcgatgtaagaatcaagagttcagggaggaaaaccattgaacgttgttgcagattctttgcatgtgtgggctcctaacatatcaaaaactattaagctttcataagctgtgcgacccattttacagaggaggaaaatagagatgctaagtaactagcctcgggtgccccagccagccggcattccacagcctcccaagacgtttgttcgtacgtgcagaggattttagtgcttttagaaaaaaaaaaaaaaagcaataaatatagagtataacctagcaaaattccatttcctatcatctcgaattattactaacattttgcatattcgcttcaatttttttttttttttttttcctgagactgagtttcgctcctgttgcccaggctggagtgcaatggcgcgatctcggctcactgcaacctccatcttccaggttcaagcgattctcctgtctcagcctcccaagtagctgggattacagtcgcatgccaccaacgcccggctaatttttgcatttttagtagagacggggtttcatcatattggtcaggctggtctcgaactcctgacctcaggtgatccgcccgcctcggcctcccaaagggctgggattacagacgtgagccaccgcgcctggcctgaaattgtttaaattaaaattaaaattaacactctagataaaattcaagtctcctttgatgtccccaagttctattcccccttccttctctttcaggagtttcccatcttttcagtatgcattttcctaatttcacaatcacatagggttgtctatttccttgcacgtttaaggaaaatggcaaacaaaaatccaaggttgtagagacagttgggtaagtgggagtggcagtctgtataatgacccctaaagatgcccacacttgaacgtgtaaatatgttaccttccgtggcaaaagggacttttgcagttgtgattaaattaaggatcttctgatggggagaggagcctggattatccaggtggtcccaatataatcacaaaagtccttataagaaagaaacaggtagccaggcgcgatggctcatgcctgtaatcccagcactttgggaggttgaggtgggcaaattgctggaggtcaggagttcgaggccagcctggccaacgtggtgaaatgtcatctctactaaaaatacaaaaaattagccaggcatggtggcatgtgcctgtaatcccagctattcgggaggctgaggcaggagaagcacctgaacccaggaggcggaggttgcagtgagctgagatcgcgcaaccgcactccagcctgagcgacagagcgagattccatctcagaaaagaaaaagaaagaggcaggaattcaaggaggtatgagggtgaaaacagaggtcccagtgatgtagccacaagctacagaatgtcggcagtctctagaggctggaaaaggtaaggaaattgattcacccctagaggcaccaaaaagggaacacaaggtgtctgacaccttgatgttagcgtttccgacttccagaacagtaccactataaatctgtgttgctttaagccactaaatttgtgttaatttgttacagcagcaataagaaactaatcaagtgggtaaacccatgggcttgggaatgacacagtctaaactcccatgagctgtgtgatcttggaaaagtcacttctctctgggcctcagttgctcatccctgtaatggagtgataatgatagtatctaccccacaggatttgctgtgaggattaaactcattcattctgcaaatgtttcatgagcacctacaatgtgtcaggcactgctccggttatatcagaggataaagtcaatacagattaaatgtggtaatttggccaggtatggtggctcacgccagtaatcccatccctttgggaggttgaggtgggaggattgcttgaggccaggagtttgaggctacagtgagctatgatcataccactgcactctagcctgggtgacagagagagatcttgtgtctaaacatgtgccaagcatttagatgaatctctggcacatatgagaagggtgacggtgatgactttgttctctcctggtatctcaagggttcccaccacaagggttctttttggtttttgttttcttctgttttgttttgttttgttttaagacagagtttcgttcttgtcgcccaggctggagtgcaatggcatgatcttggcttactgcaacctccgcctcccaggttcaagcaattctcatgcctcagcctcccgagtagctgggatgacaggcacccgtcaccaagcccagctaattgtttttgtttttttgtattttcagtagagacggggttttgccatgttggccaggctggtctcaaactccttgacctcaggtgacccaccggcctcagcctcccaaagtgctgggattacaggagtgagccaccgtggcccagccaccacaagggttcttatacaggcactggccacttggtggtattccacacacatctctccaaacaccctgtttcaagtagggggtctctcccaggatgatactgggccctgctaggaggtcaactccaggaaggcaggtgatggtgtcttgttcatccactgctgtatcctcaggacctagaacactgttggcagcaggaatattccttgaaaaaaaatagttttgcattcttggttaagtccactccatcttgccacatgaacttaagagtcagagacagatgctttcagctggagctgcccaatataagggctcagagaacttttgtctggacttgagtttcagcgaggaacacccattacttttgcaaaagttattttgtgacttgtgacttgccctctgtggccacaagaaggaagcagcgtcctctttaggtaaattcccctacaattgctcaaagcatcttctggcagttagtccatctgccaacagcatcatgtcccctaactctgtctctgatcatttaatgcaagtcaatacctgtcctgcacctactaggcctcatcaggcaaaaagcaggccttgcgggctcggggagggggatgagagctgtttctggagttgcttagaacccttgtgctggagttgcttctgtaacagaataaaaatccagtggtggagccagacgcggtggctcatgcctgtgatcccagcactttgggaggccgaggcgggcagatcacctgaggtcaggagtttgagaccagcctgtcaacatggtgaaactccgtctccactaaaaatacaaaaattagccgggcgtggtggcacactcctgtaatcccagctactcaagagcctgaggcaggagaatcacttgaacccaggaggcggaggttgcggtgagcagagatcgtgccactgcactccagcctgggcacaaagcaagactccatttaaaaaataaaataaaatccagtgttggacgcaaggccgccagttcctctgctccaccctgcatttctccaggccccgtcgccctgctggcctcccacagtcctgctgacgaggcgtctctggtgattcatgccttcaagggtgacgctgccagggcagctcatatgcaaagcccatgcaaagcccagccacagccaggcaagggtggggaggccacaggcgccagagcagccgggctatgtttggttttttattttttatttttctatgtgacatttaaaaataacttttgcaaaagtaacccattttccttgttgaaactcaagcgaagaaaggaaaagcacaaataaaaaaatatcttttcatgtctccacccagttaaactctgtcaatactttggtaagggacctgggttttgtctttttaaaatttgtaatataggccgggcacggtggctcacgcctatagtcccagcaatttgggaggccgaggctggtggatcacctgaggtcaggagttcgagaccaggctgaccaacaaggtgaaaccctgtctctactaaaaatacaaaaattagccaggtatggtggcaggcacctgtagccccagctactcggaaggctaaggcaggagaattgcttgagcctgggaggcagaggttgcagcgagctgagactgcgccactgcactccagcctgggcgacagagtgagactctgtctcaaaaaaaaaagaaaaaaaattgtaatgtaatgcatgctcgttgtacatttttttttaatgtcaaatcaaaagaataagataaaaaaaagaaaaaagtcaaatcacaggcatcaagttaacagggaaattctctccctcaccacagccctccttcacaaccgaatcccacagctcagaagtaaccattatgaagagtaccagtttgggctgggcacagtggctcacgcctgtgatcccagcactttgggaagctgaggcaggcggatcacctgaggtcactgaggtcaggagtttgagaccagactggccaacatggcaaaaccccatctctattaaaaatacaaaaattagctgggcatggtggcgccctcctgtagttccagcttcttgggaggctgaggcaggagaatcgcttgaatccaggaggcggaggttacagtgagccaagatcatgccactgacctccagcctgggtgacagagccagattgtctcaaaaaaaaaaaaaaaaaagaaaaagaaaagaaaaagagaaaaagccgggcatggtggctcacacctgtaatcccagcactttgggaggctgaggcaggcagatcacttgaggtcaggagtttgagaccagcctgaccaacatggtgaaaccccatctctactacaatacaaaaattagctgggtgtagtggcggacgcctgtaatctcagatacttgggaggttgaggcgggagaattgcttgaaccctggaggcagatgttgcagtaggctgaaactgcgccactgcattccagcctgggcaacaagagtgaaactccatcttaaagaaaaaaaaagaagaaagaaagtactttccagatcttttcctgtgcaaatatataggtgaatgaaaactcgaagccctgatgtgtcccactctcatcctggggctggctttacacagggtaggagaggaacatgcgatctaaaagaagagtgggggtcgagtgtggtggctcatgcctataatccccggcactttgggaggccaaggcaggtagatcacctgaagcaggagttcaagaccagcctggccaacatggtaaaaccccgtctatactaaaaataccaaaaattagctgcgcttggtggcaggtgcctgtaacccagctacttggaaggctgaggcaggagaattgcttgaacctgagaggtggaggctgcagtgaaccaagattgtgccactgcactccagcctgggtgacagagcaagactctgtctcaaaacaaatacacaaataaattaactaaattaaataaatacaagacgagtggtgtctcatcacttccttaagtctttcagtagctacaggtgggccatccagatggctctgtgttgggcatttctcatacctagtaggcccaggacctctgagccaaagaggtgaaacacacaacccaagcccactgtgcacagggaatttgggcagttaacagtttggaaaccagacccttcctgtggtgcctgcggccagtgcagctcttcagccccaccctgagcagatgggaggattacacctgtcttgttgcagttgggaacagccacgtgactgtgactgtaagacctggggctctatcaccatggtgagatggaaacaccatgagtcttttttgttttgttttgtgacagctttattgctgttataattgctgatataattcacacacttttttttttttttttttgagacagagtcttgctctgtcacccaggctggagtgcagtggtatgatctcagctcactgcaacctccacctcccaagttcaagcgagtctcttgcctcagcctcccaagtagctgggactacaggcatccaccaccacacctggctaatttttgtatttttagcagagacggggttttgccatgttgcccagactagtctacaactcctgggctcaagtgatccacctacctcggcgtcccaaagtgctgggattacaggtgtgagctaccgcgcctggcccatacacccattaaaaaagtataattcagtggtttttagtgtattcacagaattgtgcaaccatcagcacaatcaattttaggacattttcatcaccccaaagaagaaaccctacaactattaatagtcactccccctctccccaagctcccttcccagcccctggcaaccactaatctacttctctctttatggatcgattgtcctattcactgatataaatgaaatcacatagtatgttgtcttttgtgtctggctcttttcacatagcatattttttaaggttcgtccgtgttgtagcatgtatcagcacttcattcctttttgttgccaaatagtatttcattgtatgaatctactgccttcttttcttttttgagatggagtctcgctctgtcgcccaggctggagtgcagtggtgtgacctcggctcactgcaacctctgcctcccaggttcaagtgattctcctgcctcagcctcccgagtagctgggatttcaggcacatgccatcacacctggctaatttttgtatttttaatagagacggagtttcaccacgttgttgccaggagttcaagaccagcctggcctcaagtgatccgcccgcctcggcctctcaaagtgctgggattacaggcataagccaccgcctggcctactgcattttaattatgcattcatcagtcatttggattgttttcaccttttgcctattatgaataatattcccatgaacattttgtataagtttttgtgtggacatatgttttcatttctgctaggatttgaattgctgggttatacggtaacttcatgtttaattttttttaagaattgccaaactgctttccattcctaccagcagtgtatgagggttctagtttctccacatccttgccaacacttgctattatctgagattttgattatagtcatgctagtgggtagtgggtgtgttttgacttgctttttttggtcacccacgctggagtgcagtggtgcaatcatagctcacggcagcctccaactcctgggctcaagctatcctcccacctcagcctgtcgagtagctgggactacaggcacacatcaccgagcctggctaatttttctattttgtttttttgtagagatgagggtcttgttatgttgcctttgctgatctggagctcttgggctcacaccatcatcccaccttggcctcccaaagtgctaggattacaggcatgagccaccatgcctggccttgcattttcttagtggctaatgacgttgagcaccttttcatgtccttattggccatttgtatatcttctttggagaaatgtctattccaatctttggcccatgtttaaattggagtatttatcttttattattgagttgtaacaattctttatatattctagctgcaaatcccttatcagatatgatttgcaaatattttttccccattctctgattgtcttttcactttcttttttgtttgtggtttgtttttgttattgtattttgagagaaggtcttactctgtccctcaggctagagtgtagtggcgggatcttggctcactgcaaactctgcctcccaggtccaagtgttcttcccacctcagcctcctgagtagctgggaccatagatgcaagccaccacatctggctaatttttgtatttttttataaagatgaggtttcgctatgttgcccaggctggtctcaaattcctgagctccagcaatctgcctgcctcccaaagtattgtgatcacaggcatgagccactgagcctggcctttttcatttatttatttaatttttacagacagggtctcactctgttgcccaggctgaagtgcactgcatgatcatagctcactgcagtttcaaactgctgggcccaagggatcctcctgcctcagcctcctgagtatctgagactacaggcacacaccaccatacctgggttttttttttttttaatgttttattttagagacaggggtcttgctatgttgcccaggatggttttgaactcctggccccattgatcctcctgccttggcctcccaaagctctgacattacatgtgtgagccaccttgcccggccttgagtaattttattttaccgcagtagacatctccttgaaggcaaatgtttcccccaattcctagcaccatatttggcacacaataggagcttaataaaatttgccataagaattaatgctcagaaactctactattacatcctatctgctcaactccctggaaaagagacattctctttttatggttactataaaaggcccagattagtatttcactggcctaacttggatcacatgctcatccctgaaccaatcaatgaggctgaagggatgaaatatgctaattggccaggtctggtcatgtgtccatttttggagccaggggagtggggagggctattttcctgaactgaaatagggtgaactggttccctgaagactaaccaagacgctaatgcaaagaaggacactcctgctgggcagacaaaaatgacagaggctcagagaagtaaaataacttgcccaagggccatagagctttaagcagtagcgtcttttttttttttccaatcttgctttgggcttggacagactagttcagcatctttgatcttcccttcctgcctgacggccccagggtcagaattccaggtgcaattttgtcttgccaaaagctggagtttactctctttggggtttataaataaggaaaaaagttctttggagagcctgaactttgaaatcagagaagtctggatttactgctggctctgccttttctagctgcctcacctggggcatgtcattatctctataagcctcagttttgttcttttttcttttttatttttttgtttttgtttttttgcgacggagtctcattccttcacccaggctggagtgtagtggcgcgatctcggctcactgcaacctctgcctccagggttcaagcgattctcgtgcctcagcctccagagtagctgggactacaggcgcgcccggctgcttttttgtatttttactaaagacagggttttaccgttttggccaggctggtctcgaactcctgacctcaggtgatctgccggcctcggcctcccaaagtgctgggaagatggaatgagagaaatccctcaaaacatgtcattgttactacttttctatctagaatgtgtgaaatttctaaaatttcactaacaaagtatctggaaggacctaatattaaagtgttcacagtagctattagttttaattcgttttcttttttataccttagccactctaccactcatgccacaggtatttattaagcatctactgtgtgccacccaggccctgtgtcaagagttaggaataactaaaggagatactaattttaaaactacacaaataattgcaatcgtcatacgtgcctgtttttacaaagcagaaatcaggaaaaacaaagtatttccgataaaaaatattttaaggttatggatagagatacatacaaacaagcgatgggcttggatcactaatgattttggaaaggacaggaatacaggaactaagcgagaagcaggcgagaatggcgaggcgcggcgggagaggacggaagttggtcactccctcgaattgccccctcgctgccggatgctaggccagccttgagcaggagaaccggacactgtgtactcagcagggggagccaagacttagcgctaaccattgcacctggggctgggagccagcgccggagccaggaggcccgctaggcggctgcaggcgctgtgatggccacctgggggcggccacgtgagcgccacgccgtgcgcccgccaggccagccccgcccctgcccgcccgcttctgctcaacctagaccagccccagcttcagcctcagctcccctccttcctggatcgagcgcccgcactcccggccctgcagccacccgagtcccgctcgctgtcgcctgcacgcgagtcccccctggcacgcgctcccacatcccgggatcgtcccaacggcccctgcgcccttcctgggatcactccgactgccccgcgcgccctgggatcggtccatctaccccgcgtggccccagctgcttgcccggagcgccagctagcgctccccgctctccgctccccggcactctcggggggcccgcccgccctgcaccctggagctccgggccgcgagcctctgccaactcctctggaccctcgcggccgtgggcagcggctgccgcgcctgtctgcccgagggaggtaggtgtggaccgcggccggcaaggctgtggggggctgggagcccgcgctgcaggcctgtgcgcccgggtgcagctggcgtctggagcgtgctgggtctgggcttgggaatggggccggagaaggcatggaaggagagtgtgggggcgcttctcctctggttgttaaactctctggggctaagtgcttgctttggagaaatggggaagttgtgcggattaaaggcgatgtggatatggaaagcaattggcaagcaatgggcggtgatctggctgcaagtgacagagagtttgggggcctcccccctcggggcccctagagtgtgggcgcatcgctgccttcctgtcccctgcagggctcagagccgcatcccccacctttcccctgaactagaggcctgcgtcagcccgaattcccggaacctccaggactgtatagacgcgcccttgctgcattgttggctgcgggagtttgttggcaggcgctgctgacatgtgtgccaaggggctgggcattaataagccggtggccgcgcgggggtgggggcctcccgggtaagccccggcctagatccttttgcgcgcgcctgggggatttcggggaaccagcccagctgcgccctgagtgtgacagatgggccgcatggggaagtgagatctgcccagggggacggtcccagggagcccgacctctgggacctcggtggtgggtgcttcttcagccaggaaagcaggaaacactagggctggagtcctgggttggaattctagctcatttatgctctctggccctcggttttctcatcggtaaaatgggtacagtattagtatctaccacttagtatccttggaaagagtagatgagtatgtatatgtcaggtgcttggaacagtgcctggcacacagtgtcatagtctatggccccgggagacatctgatggccaagagccctgtggttgagggccctggacaggctgtgaagtcacagcgaattgagtcacgtagtctatcctaatgtttttagcgaggaggaaaccgagggtcagagtgatccccaggcccacagaagctccctaagaggaagccagtcacataaacagattctaaaaagcgagatggagtaaatgggaatacagagcaagcaggtgggagctgagaatgcccactgtgtgtgtaaaggggagagggttatgggggaaggcttcctgtagcaagtgctgtttaagctgagctggggaagaggcaggtggaaggaggtagagttcagagatggcgtatgcaggtgtcttccttctgtgtggcctccacagcacccgatgttcattcctttgttcagctattaattcaacaactacagtaaaacctctcaaggacatgaatttcagtgtaacatggctgggattggcgtccgccctcctctcagcccccattctcaaagaagggggtggggtccgaagttcttatcctctgcagggaatggggaggccagaagacagaactgaagtggtcacagtttacacataatcatcggtgtacattccaagagctaccggtgttttgggccaggggcgtggtggctcaggcctttaatctcagtactttgggagactgaggaaggtggatcacttgaggtcaggagtttgagaccagcctggccaacatagggagcccccatctctactaaaaatacaaaaattagctgggcatgttggcatgagcctgtaatcccagctactcgggaggctgaggcaggagaatcgagaatcgtttgaacccaggaggtatagtttgcagggagctgagattgcaccactgcactctagactgggcaacaaagcgagactctgtctcaaaaaataaaaaagatccaccaatttgtttttcttgtgctttttgtaactgtacagtactttttggctgattacggatatatcactggctgggtgtggtagctcacacctgtaatcccagccactttgggggtgctgaggcgggaggattgcttgaccccaggagttcaagaccagcctggctgacggggtgaaacccggtctctatttaaaaaaaaaaaaatctctgatttgcttttaaaacattttactgtattatgtggcagagaaagctatgggtcaccagtacccatgttctcgtcctcctggggtgctccctggatgaattttcctaggcttccttaccattcggtagggccacacggctgagttttggctgatgaaatgtgagtgtgtccatttcaagcctcgaccctaaaaacctctcactctttccttatttgttggacaagtcaaggcgactttgaaggcctagaggagggcagagccacaagccagagggagtgtttgttgtttttgagatggagtcttgctctgttgcccaggctggagtgcagtagtgtgatctcagctcactgcaacctctgcctcccagattcaagtgattttcctgcctcagcctcttgagtatgagctgggactacaggcacatgccaccgtgcccagctaatttttgtatttttagtagagatgggatttcactgtgttggccaggctggtctcaaactcctgacctcaagtgatccacccgcctcccaaagtgctgggattacaggcatgagccaccatgcccacccgggaaggatgtctttagggttgttatcttgctgtggggagagtccccaaagcagtcttgtccagtttttggcagggttgtcgtctggttgccgggactctgggagctgtgtgaagaaagccaagggtgaacagcagaagcttggacttgttcaagctcgttctccgggattcactatttctggtccagttcttacacctgaagcagaacaactgaatgatcagggctatagacaaagtaatagcggcaggttgaactaatttaaaagaatcagtgttttttgttgagggagattggttctgctgacctgaaagctgcaggttattaccctgatgaactgagaaggctcctagaaggtggttagagcgatgaccttgtctccacctgggatgaaagcggcttgggccttaaagtgttgctggatcaaattcttgcagccaaggctgatgagcacaagcaaggaggcttcttttttgttgttgttttgagacagggtcttgctctgtcacccaggctgcggtgcagtggcacagtcacagctcactgcagcctggaactcctcggctcaagtgatcctcctgcctcagcctcccaagtagctgggactacagacatgagctaccaccatggctggctaacttttaattttagtgtagagatggggtctcactctgttgcccaggctgggcttgaactctgggctcaagcgattcttctgtctgggcctcccaaagtgttaggatcacaggcatgagccgtgcccaaccatataagaaggcttcagacaaaggaaggagtgagtcactaacacgctgatgataaagcagaaaataacagtgctccccacaacccccaaagtcccagggctgtgggactcctagagaagcgtctcaaatggctccagagtcagaaggtggatggcgttctgttctccagctgtgaagctttcgagctctagcaaggactagcaagccagaggaagcacccggaagtaggtggctaaactgcggaaaattgccctaggccagcgtttctctaacttcagtgcacatcagcatccccagcaggacttgcttacactttgattgctggacccatccccagagtttaatttagtaggtctgtagtgaggcttgagaatttgcattaccagcaagttgccaggtgaggctgctgcagtggctgctgcggcagctggtcccatacttttagaagcgctggttaaggaagtgatgactgcattgaaagctctggattcagcccgcaccagcttcaaacccaactctagtcatgtgatttgggataagtcacataacctctctgttccttagttttctcatctgtagaatgaagctaagagcgactaactcctggggttcaggggaggcttcatgaaggaggtgatatctaagctgagacctgagggatgagcagtcaagttggccaggggatgagtagggaggacaggctggggtgtgtaccagacagagggcatagcatgttcagagcccgaggaggaaggagtgcctgccttctagggagctgggaggagttatgtagcaagtgctttgtaagtgatactgaaatgctaccaatctgttctgggcaggatcacagtggagaggaagccaaccagggtatggaaaatgggctgctggacgggctcagaaatggtacaagttatttgtgctctttcattggccagaatgcagtcacatgaccttacctagctgcaagggatgctgggaaatgtccgtggccaggcaggggagaaaggattcctggaggaaagccagctctctgtgccacctgtggttttcaggccccctctctcacttcttctccaccttgctcactttgctccactctgttgagtagatgaattttacagatgaagaagctgaggttcagaaggttaagtaatttcccccagcattcctcagctgactgtggcagggccaggacttgaattcatcccaaaggccttgtttggctagatctggttttggtgcttatcaggtcctccatgagccagtctttcccactacgacctcagccatgtcattggactaagtaactcctatgtagttacaacacagtaggttgttttgtttgtttttgtttgtttgttttttcggaggtctgggggcggggggatagagtcttgccctgctgcccaggctggagtgcagtggcacaatcttggcttactgcaacctctgtctccttggttcaagtgattctcatgcttcagcctctcaagtagctgggactatacaggtcgtgtgccaccacacctggctaatttttgtatttttggtagagatggggtttctccatgttgcccaggctggtctcgaactcctggcctcaagtgatctgcctgcctcggtctcccaaagtgctgggattacaggggtcaaccaccgtgcccagccacaacccaaaagtccttctgtttctccattatatcagcaggaaactgccagcttttcttcacttactcgttcattcatgcagcatgcacttgtgcatttatggtgtgtgccaggcattgtgctttgggctgggagctgcagaggaacaagacacacggccccttttgttcaagacactcacatggtctggccaccgagagggctgggcacacagttcatgtgagaagtgagacgtgctgtatccctgagctgacccaccaggagtagagtgtaccgtggacatgcagagagtgcccagcaagtgattaaacattacagttcaagctcccttgtgcattttgctaatcaaagctataattatattttgtgtttcatattccaaaatgcatttttcagattcctgaaacaataaaatagcccttgcatgatgacagttttatatgcagaaaacacagtgtactgcaatgatatttttacgagcctttagcagagcaaatgatgacgtatctctggcttctgcagcaggttgctgtttacatcggtaagttgatttctctgtctctttctttttttttttttgagacagagtcttgctgtgtcacccaggctggagtgcagtggcacgatcttggctcactgcaacctccgcctcccaggttcaagcaattcttctgccttggcctcctaaagtagctgggattacaggtacacaccaccacacccagctggtttttgtatttttagtagagatggggttttcaccatgttggtcaggtctcaaactcctgacctcgtgatccgcctgcctcggcctcccaaagtgctgggattacagtcgtgagccaccgcacctggccttctctgtctctttatggtatgtggggagatttgtttttaaaaggaaaaggggaagagagggttggggagggctccttaaaattacaccagaggctggacacagtggctcacacctgtaattccaacactttgggaggctgtggctggaggatcacttgagtccaggagtggcaagacaccatctctacaaaaaattttttaaaataagccaggcatagtggcacaggcctgtagtcccagctactcaggaggctgaggcgggaggatcccttaagcccaggagttcaaggatgcagtgagctgtgattatgccactgcactccagcctggatgagagatcaagacacccacccagtctcttaaaaaagaaagaaagaggccaggcacagtggctcacgcctgtaatcccagcactttgggaggcggagatgggtggatcacctgaggtcaggagttcaagatcagcctgggtgacatggtgaaaccctgtctctactaaaaatacaaaaatgagccaggcatggtggcacacacctgtaatcccagctactcaggaggctgaggcacaagaatcacttgaacctgggagatggagtttgcagtgagccaagatgtagttgctgcactccagcctgggcgacagagtgagactccatctcaaaaaacaaaagaaagaaattccaccagattcattctagagctgggtttctcagcctcggcactgacattgggccggaccttcttcactgcaggggactgttctgtttattttaggatgtttggcagcatccctggcctctatccactagatgctagttgcacccctagagtttcaacaactgaaaatgtctctagacattgccaaatgtcccttgagggagcaaaattgcccaaggttgagagctgctcttcaggacttcgttagtttccaattgctgctgtaacaaattgctgcaattacttagtggctttaaaacaacacatttattatcttatagttcctggggatcagaagttctaaaatctaggtgtcagcatggctgtgttccttctggaggccccaggagaaaatcggtttctttgccttctccagattctaggggctgtcctcattccttgggctcctggcccctcccttccatctttgaagccagcagtgtggcaacttcacacctttctgtctttggtcacatctcttcctctaactctgacccttctacctcctttttataaggatccttgtgattacactgggctcacaggataatccatgactgtctcccatcttaagatccttaatcacatctgcaaagtcccttttgccatataaggtaacatattcacaggttccagggattaggatgtagccatcttaggggagccatgtttctgcctgccgcagacagtctggcctcaggttataatgaaatttgcttgtggagggtttgtagggagcgaagtgatttagggagtcggggactggaggattattgggacataacagcagctagtacttttgagagtcaagtctatcccagacaccatgtgcctaatctcattgtatcctcagaacaacccctgcaggggtactgttagctgacccctgtttacagaggagggaactatccaaggaaggctttctggaggccaggtgcagtagctcatgcatgtaatcaactttgggaggtcgaggcaagaggatcgcttgaggccaggagttcagaggcaagaggatcacttgagcttgggagactgaggctgccgtgagccatgattgcaccattgcactccagcctgggtgacagagtgagaccctgtctcaaaaaaaaaagaaaagagaccagcctgggcaatgtagggagacgcccatctctataaaaataaaataacataattagccagatgtgggtggtatgcacctgtagtcccaggtacaatggaggctgaggtgggaggatcacttgagcccaggagttggaggctgcagtgagctatgattgcaccactgcactccagcctggccaacagagccagactctctcagcaacaacaacaacaacaaacccaaaagaaacaaacaaggaaggctttctggaggaggtcaacatttgagctgcgtcttgaagagattaaagggttttgctagtgagtgggaaagggattccaggcagaggtgttactggtggagggtgtccaggttcttggcattttgagcaaagaattggacaaaacacacgaacaaaacaaggaaagaaagcaacgaaagcaaatatttacagaaaacaaaagtacactccacagggtgggagtgggcttgagcagattgcttacagaattgcctggggtttaaaaaccctctagaggtttcccattggttacttgatgtacaccctatgtaaatgaagtaatggcctgggatcagtctgataggttgtggaatgcgaccaatcagaggctgaagtgaagttacaaatgaagactcctatacaaacgaggacttggccagcaccagcctgattggttgtgggaagggaccaatcagaggtaacttcagtttttcatctgccacgcaggtaagttgggggttgcaaagggagtagcctctggtccttttgttacttgggcttggaaagtaggggttttccttttgatttagttctaggaagtcagcctgaatcagccttaggttccctgcctccagaccctattcgcctgcctcagaggcacctgcagatagatacaagggcaaggaggtgaggagagtttggtggtgcatggagattgattcttggacttggaaacttgggaagctgagatggcagggaggaagggacggatgggctggactctgtaaattggtcctttcattctgatgtactatttctctcaatagtttaaataaatgtttatgagcacccattatatgctaggggtgcagacattaagacactgatgtgaactcttagcttgatgcttgacttaatcactcctaatgctgcatcccagtaaataaacactgagcagccagacacggtgactcacacctataatcccatctctttgggaggctgaggcgggtggatcacttgaggtcaggagttcaagactagcctgaccaacatggtgaaaccccgtctctactaaaaatacaaaaattatccaggtgtggtggcgggtgcctgtaatcccagctactcgggaggccgaggcagaagaatcacttgaatccgggaggcggaggttgcagtaagccgagatcacgccactgcactccagcctgggtaacagagggagactccatctcaaaacaaaagaaacactaaacataagggtatttgagttcatgttgagcacctgtgcactgaaggcaatacaaggtatggggggagggatggagacagcagtgcagaccttaggatgtcacagcccacctgacaagtctattgtctaggagagggtcccagctcctaatggtggggcccaggattcaaaccctggccatgcggctgtagaggacaagctgttagccactgtattgggctttggtttttgtttcttgtttgaaggaaactcgggactccagctagggtttaaaatatcttcagaacaagccaggtgcagccctcaacagcctagcgctgtgtagttccgctcccttaaggttgccttttcagaggtagactgtcacttctggacctagcagctcctgtcattgtcagaggagagtccagtgtagcacctggtgtgcagtcagtctttcacgtgcattatttgtctttcttatttccatagaaattacgcctttttgaggttgataagcttttgaggttgataagcagataagtagctcttctgcttacttatcactcattcacagcacaaaagccacactctcccttctctgaattcgtgttaaactgtgagaaactcagcttcttctagttggtggaataagacagtgtccttggcatggtatgtaaaggaaccagatggctgggcactgtgactcatgcctgtaatctcaacattttgggaggttgacgcgggaggatcacttgagaccaggggcttgagactagcctaggcaacacagcaagatgccgtctgtaataaataaataaaggaaccagaagaagacctaccagtgtagggatagggtggggaagggaagtagtaaggggaagtagagctaaagtctcatttatcatacctggaaatcagaagataggatgaaaatagataaattaagaaataatcagggccgggtgcagtggctcatgcctgtaatcccagccctttgggaggctgagatgggtggatcccttgagtccaggagtttgagaccagctgggcacatggtgaaatcccatctcaacaaaaatatacaaaaattagctgggtatggtgacgcgtgcctgtggtcccagctactccggcggcttatatgggaggatcacttgagcctaggaaacagaggttgcagtgagccaagattgcgccactggactccagcctgggtgacagagcaagaccctgtctcaaaaaaaaaaaaaaaaaaaaaaagaatcaggaagcgtattatttagtgatatatatagatagatagatagagagagagagagagagagatgcgaaggataacactgagaatagttggaagtagttgcctctagggttgggaagtagggctgcccgtgcaaagttgcaaaggttgttcactagagttgagcagtaccccacctatatgatcatatacagtggccctagtaagaaaaaggtgtttaaagcatttttaaaattatatataaataatatacaatggcccaaaccctggctgggtttggacagagtctcactctgtcgcccaggctggagtacagtggcacgatcttggctcactgcaaactctgcttcccaggttcaaacaattctcccacctcagcttcccgagtagctgggattactgggattaccggctcgtgccaccatgccccgctaatttttgtatttttagtagagacggggtttcaccatgttggccaggctggtctcgaactcccgacctcaggtgatccacctgccttggccttccaaagtgttgagattacaggcgtgagccaccgtgcctggctggtttggggattttcatattgcatgtgacagaaaacctatctgtaactagctaaatagccctttcccctactgccccccaaaaggcggggtttattgtatcatctgattcagaaatctacgctgggcttggtagtttggtttcgggaacatctggattccaggtctcaaatgacatcatcgctattcatttttctctttctctggttctgccctccaccacgtatcagctttgttctgtgttggcctcagccccattctcaagttcacattcagcatgaaaaggctgatcacctcttccagtcactcaagcaaaaagccccaggtttgctgcaatgggctagaatagtttgactgtaatcacatgaccacctctaagccaatctctgtggccaggcaccccagtggttggtttaggcctggatcttgtgacacactcctgaacacatgactcgagggtggggcagaggcagatcctcacacagaagctggtgcgtgattccaggtggctgatcaatcacctgtgtccactgtggttgtagtcaagggcgtgtgggttgtgctgtgctgggcgtacactagtgtgtgcattggccagctcggggtgccacgttattggctttgggatgctggttcccaggagtggcggtgggaagattccacctgctttctatggtaggaaggcaggtcctggggtgagggtgagccccgagggggaccagtggccactgtggcttgacccgcaggccttgacctgagcattgcaggcatagtttcctgcccctgtaactgccagatcgagacccagtgagacagtggtttccgtcgccagagactgaaatagtgtattccctgaggacccctgaagaagcttggctttgctacgagccagacgtccaggtcacaagtctggctgggacccaaggctcagtccctttataatagctgttgagttcacggagtgagtacaattatgcatccccactgaggctcaagaggtgaagtcacatagccagttagtggtagagatggggcttgaacctgggtcttcctgactcactcagctacctttccatagaaatagggactggaggccgggcgcagtggctcatgcctttaatccccagcacgttggaaggccgaagagggtggatcacttgagggcaggagttcaaacaaaaaaattaaaaaaaaaaaaaaaaagagaaaaaagaaaagaaatagggactgggaggagaagatgtggatgcctgagtgaggtagagaaagctttcaagaaaaatcctgatgtctttcagctggagtcctattcttatcacaggagtagatcctttctttgggccaagggaaccccaggatagatagagacccctaggaggctgggcatcttgcctggtgttagaacaggcctcctggaactgacttaaaggctaaggaaggttccttgcttgtttggggaaatccaacatcctccaggtacccagtcttcatgtgcaaatgtaagagtatctgccaagttaggactatggattgaggccacagttttcccaggttgaccctgcccaggcacccatttgtcataaaggttgtgacctttaggccaggtgcagtggctcacgcctgtcatcccaacacttcaggaggccaaggtgggaggattgcttaaggccaggagttcgagactagcctgggcaacatagtgaaactgtgtctctacaaaaataaaaaattaggtgggcatagtgacacacacctgtagtcccagctactcaggaggctgaggtaggagaatcacttgagcccagagatcaaggctgcaatgagctctgattgcacaattttactccagcctgggcagcagaacaagaccctttctcaaaaaataaaactttacaaaaaagaggatgtgactttttatgatatgggagagaaggagctactgttaccaaataaaattagcaagtagaaaggaaaaaagaaaattacagtagattatacaagtttagctatcagagtatgaagtttctgaatccaggattgttatgctgtcccatggtataagagacccaggttctgtttgtctcatagctcttccagcctcagcacagggccatccgcctcatggtctagggtagctgcttgagctccggcaatcacatgtgcatttcagccagcaggttggaaggagagccaaggggcacactccctttaagaacccttccctatggttgcacacagtccttcttatatcccattgactaaaacttgttcacatgtttatatctatctgcaaaggagtctgggaaatgtatcctgagtggccacgtgacatgcttagccaaaacccggtggttctcttatcaaggaagaaagagtgaacagctattgggggatagtttgccacagctgccttaagagcaaatttatgacaactcaaaagccataaaacagatgacactcacttagctctggaatgcatatcaagtgcctgctgtgtacaaggcgctgtgccaggcagggtcacagctgcttgtcttcatttcccagggccgaggagaacgtcaggtctgtggtgggacatggccgagggccgagctccccacactgtaagatgagggagtcggctccgtgaattaattgggtaaggagccagatttgctcgctagcagcccagatcctgaatctgagcgtgcttttttttttgttttttgcttatttgagatgaggtcttgctctgttgcccaggcagtggcacaatctcaattcactgcagcctctgcctccccagattcaagtgatcctcccacttcagcctcctgagtagctgggactacaggcacacaccaccacgcccggctaatttttgtattttttcgtagagacaggatttcgccatgttccccaggctggcctcgaactcctgagctcaagcgatctgcccaccttggcctcccaaagtgctgggattacgggcatgagccatcacgcctggccctggatctgagcttttaaccaccgaactacactgtctggaggtctgcagcttggggctgtggttctggccctcctcctggcactgtcctggcccccagtggccgctgactaggctgggcctgctggcagctcctggcaccacgccgtgttggtcagcagggattctggccaagggctgaccagggcagagtaggcgctggggctgggagcagctgacagtgaggagaggccagtccagggctcagggaagattctggtgacaagcaggatcaggtggctctggcattggatccaggcctgtgactgtgtcttgcccagaggataagaaacaaactcagtagttcacgttggttttcaaacggtgagtatagaaatcaatgtgtgggtggtgtgttaaggaaaaagattaaacagaaagaaaaaacagaggacttaagtagaatagaaaatagcaagagtgggccaaacacagtggctcacatcagtaatcctagtgctttgggaggccaaggtgggaggatcacttgaggctggaagttcaagaccagcctggccaacatagtgagactctgtctgtacaaaaataaaaaactttagccgggcatggtggcatggactgctctggaggctgaggcgggaggatcacctgaacccagctgttggaggctacagtgagctgtgatcacaccactgcactccagccagggcaacctgtctctaaaaataacatttaaaaaaaaaaaatagcaagagcgcattatacaaagtaaggctaagcacaatttcttgaaattttactgtccattttataagcatgtagtgggttaggatataaatatatttcctgcttcggtagccagagtaccaaagccttggctctagaagactgtgcacctgatggacagcactgtcaaaaaaattggaattattggtttgatgtaaaaaaatttttaaactaatttacttactattttgtgtctaaagcaatccagctttgtaaaaaagttaaagcagtatagaaacatacaaagttttaaaaagctggccaggctcagtggctcatatctgtaattctagcactttgggaggccaagacgggcagatcacttgaggtcaggagttcaaggccactgtggccaacatggtgaaaccccgcctctactaaaaatacaaaaattagctgggtgtggtggtgggctcctgtaatcccagctactcgggaggctgaggcaggagaatcgcttgaacctgggaggcagagcttgcagtgagccaagattgtgccaccccactccagcctgggcaacagagcaagactctatctcaaaaaaaattaaaaaattaaaaataaaaagtttcctccagctctacagctgcttatttcgagtgctgtacagttcctgtggatttttcagggaagttttcatgcatgtacacaggtcctttttcttttcttttctttttttggagacagggtcttgctgtattgcccaggctggagtgttgtggtgcaatttcagctcactgcagcctctgggctcacttgaacctcctgggctcaagtgatcttcccacctcaaccacctgagtagctgggactacaggcacgcaccatcacacccagctaattttttgtattttttttgtaaagtcagggtcccattatgttgcccaggctggtcttaaacttctgggctcaagcgatcctcccacctcggcctcccaaagtgctgggattacagacatgaaccaccacatccgactttcttttctttaaaactttggctttcttgagataaaattcacataccttacaatctgctcatttaaaatgtacgattctggctgggagcagtggctcatgcctgtaatcccagcactttgggaggctgaggtgggcagatcacaagttcaggagttcgagaacagcctggccaacatggtgaaaccccgtccctaaaaaaaaaaaaaaaaaaaaaaaatacaaaaattagctgggcacagtggtgcgtgtctgtagtcccagctatttgggaggctgaggcaggagaatcacttgaacctgggggtggaggttacagtgagccgagattgtgccactgcactccagcctgggtgacagggtgagactccatctcagatagatagatagtacaattcaatggtatattcatagtcatatagccacagtcaattttagaaccttttcatcaactcaaaagaaaccccatacccattagcaatcattccccatttcccccaaccattcccaccaccacaccctacctccatcctcaggcaaccattaatctattttctattgctgttgctttgccttctctggaagtttcatatacagagaattagtcaatgtatatagtcttttgtcactgcctttcacctcccctagtggttgtaagtttcatccatattgtagtgtatgtcagcacctaggagtggaattgctggatcatacggtaactcagtgtttaactttttgagatgttgtttttttctgttttttttttttttttttggttttgttttgtttttagacaaggtctcactctgtcacccaggctggagtgcaatggcacagtctcagctcactgcaacctctgcctcccaggctcaggcaattctctcacctcagcctcccaagtagttgggattataggcatgcaccaccacgcctggctaccttttatatttttagtagagacagggtttcgccatgttggccaggctggtgccagagtgttttctaatttcttaatttttgggtatggcgtaaggaaggggatcaacttcatttttttgcatgtggatattcatttatcccaacaccatttgttgaaaagattcttccttccctgttgaatcatcttggcttgttgaaaatcaagtgactgtaaaactgagagtgaattatcttggcacccttgttgaaaatcaggtggctgtaaatgtgacagttctatcctacaatcttcctgaactctttcttgattatttttgtgtgtttgtgggtatgggaccgtcccctttctaacagtcacggagtatttcatggtgtagagagaaatactgtaatctgtataatgagcttctattggacatttggggttgttgggttttgttttgttgctgttactgattgtgctacagaaagtgcttttaggccaggcgtggtggctcacatctgtaatcccagcactttgggaggccgaggcaggcggatcacctgaggtcaggagtccaagactagcctggccaacatggtgaaaccccgtctctactaaaaatacaaaaattagccgcgcgtggtagtggatgcctgtaatcccagctactcaggagactgaggcaggagaattgcttgaactcgggaggcggaagttgcagtgagccgagatcatgccactgcactccacagagccagactctgtctcaaagaaaaacaaacaaacaaaaaatgcttttagggccactccttcattctgggaaagtgcattgagtgccttctctgtgccaaacacttttggaggtattgggcatacagacaataacaaagtaaacggggtgatttcagtttgagaaaagcacaatgaagaaatgaagcatgcctgtaatcccagcattttgggaggccaaggcaggaggatcacttgagcccaggagattgagaccagtctgggcaacatagggagaccctgtttttacaaaaaacaaagaaaattggccaggcttggtggcatacacctgtgatcctagctacttgggaggtttgagtgggaggattgcttgggcctgtgaggtcaagcagtgacctaggtgagctaggattgcaccactgtactccagcctggatgacagagcaagattctgtctcaaaaaaaaaaagaaaagaaaagaaaaagaaaaaagtccggatgtggtggctcacgcctgtaatcccagcactttgggaggcccaggcaggaggatcacctggggtcagaagttcaagaccagcttagccaacatggtgaaatgccatctctactaaaaatgcaaaaattagctagttgtggtggtaggcacctggaatcccagctacgcgcgaggctgaggcagcagaatcgcttgaacctgggaggtggaggttgcagtgagccaagatcgcaccattgcactccagcctgggtgacaagagtgaaactctgtctcagaagaaaaaaaaaaaagaacaaagaaagaaatggaacggggtgatatgcaagggagtgattggatatgcatgttgggttaagggttctttgatttggggattcacagaagatttcactgaagaggcatctgtgagctgtgagctcaatgatgagaaagaacccactgttagaaaggttgttccaggcacaaggaacagcaggtacaaaggctcggaggtcggaatgaacttaatgtgttcacagaacagaaagaaacccagtgtacctggagagcagccagggccggaggagaagtgggcagcacgctagatgaacgcagctcttgcagccttaccaaggcatttggattttattatgaatgtgaaaggaagctgccaggggtgggcgttaagcagaggagtgcctcgatctaattgatgtgctaaaaagagcactctgcttaagaagccattcctttcccaacctggttccaacatttgcaaacactgagttcttaaaagtggaatgacgactgggtcagcgggtttcgaatttaaaatgtgcctgggtgctgccaactgcctccccaaaagatagctctaggttttaccccaagggtgccagctcctgcgatagcctgcagcatttggggtgagggtcgggcgaattcgcagccctgggccccagcacccactctctggcccttgctttccttgtaggaccttcgcctctgcatttgtccagtaactctggctgtgccggatactgcttgggtaaaacgggcaccccaggaacatggcagacgaagatctcatcttccgcctggaaggcgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggtgagtgagccacctattccaccttccccacctggcttagctgctgtaagggatggagggttggagtcgctggttggggacttcttcgtatttccaaaccctggacagtgctctaaactctgagctgaggatatacttgttaagcagggagggtattattgatttaaaataaatttcattaccttggaactgggtgtttttcaaatagtagcccaggacacactacggagttgtgaaaaccttttgctgagttttgtccaatgttttgttttgtttgtttatttattttagctttctttagagacagagttctcctctgtcacccaggctggagtgcagaggtgctgttctttttttttttttttttttttttttaaagaaatggaacagaacagaataaaacagcaactattggggaacattgcaaactgtaaagatcttatttctttgtaaaaacgtttatttatttatggcaatagaaaatccccaaactaaggaccttatttctctttctctctttttctttcttttccttcttcttctttttttttttttttataaacgtggtctcgctttgttgcccaggctgcagtgcaatggcacaatcatggcttactgcagccttgaattcctaggctcaagcaagcctcccacctcagcctcctgagtagctaagattataggcttgtaccactatacccggctcattaaaaaaattttttttgtagaaatggggtttcccaggctggtcttgaactaccacgcccagccacttgttgttaattttttgaaagaatttatttaacaacataattttaggtcaggcgtggtgtctcacacctgtgatgccagcactttgagaggacaaaagggaggatcacttgagcctaggagaccagcctgggcaacatagtgagaccctgtctctcaaaaaataaaataggctgggtgcagtggcttacgcctgtaatcccagcagttggggaggccaaggcaagtggatcacctgaggtaggagttctagagcagcctggccaacatggtgaaactccatctctactaaaatacaaaaaattagccgggtgtggtggcgcacacctgtaatcccagctacttgagaggctgaggcaggagaatcacttgaacctgggaggtggaagttgcggtgaactgagattgcaccactgcactccagcctggacagcaagagtgaaactccttctcaaaaaattaaaataaaataaatacatttattattcattttatttttttgtattccactctgctgcccaggctggaatacagtggtgggatctcggctcactgaaacgtccgcctcctgggttcaagtgattcttgtgcctcagcctcctgagtagctgatataacaggcatgtgccaccacacccagcaaaagttttgtattttcagtagaaacagttgcactgtgttggccaggctggtctcaaactcctggcctcaagtgatccacctgcctcaggttcccaaagtgctgggattacaggcatgagccactgcacccagcctaaaataaatttaaaaacataattttattgaaaaccgtttggtaggtgccagcgtgggtacttgattacatgaaatttgcatttatttattacatattatatatctgtcaccaggctatgcactgagtacagacaggcaaacagcaattgtttacagacttaacaatctccccatttatcagcagagacattcaagcggagaaacaaatataataactattagttactttgatagaaacttgttttagggacactgaaaaaaatgatctcatttaacatttatagctatcttggctgggcacagtggctcaagcctgtaatcccagcgctttgggaggccaagatggtaggatcgctttaggccaagagtttgagaccagcctggtcaacataggaacaccccatctttattaaagaaaaaaaaaaagaaaaaatgcttacagccatcctatgtagttacagctatgaaggataaaccaaattctttttttttttttttttttttttttgagatggagtctcactctgtcgcccaggctggagtgcagtggcacaatctcagctcactgcaacctccacctcccaggttcaagcaagactaaattcttatgaatcattacttttgaaacaatacctagtattgtgtgtcacacattataggtgcttaataagtgttatttccctctctgttgccacattccaggagtgtggtcctaataatttgtcactgattatgagaattaatatattttttaaaacctttccacaaattaattaccttttcccaaatttgtttactgattaaaagctcatactgtgggctgggcgcgacggctcacacccgtaatcccagcactttgggaggctgaggcggacagatcacaaggtcaggatttcgagaccagcctggccaacatagtgaaacccatctctactaaaaatacaaaaattagccgggcatggtgttacaataaaactccagccaaggaaaagacaaagagacctttggaaaccaaagagaactttatttaattcaggtacccgggccgacagcaggcccacgcctaaaatggctgccgactgggacacagaaagcaggcttgcttatatgtcgtttgaggagggaaaacaaggcaggatacaggtttcagacaaagacagtaaattatttaacacgtgacaattctgagaaaacatataatttagttatcttgaccagtcaactttgaagctggacagctcgagcttcggggtaagggaaaacaggaattacagaaatacgcgggggtctggaggcaggcaataagcttggaagattgagataagctcatagctgcaacttgttagcaatgctgggaggggctgcttaaatttcttagcctatgtataacttctaaataacctatacttaatgttaactattacttatgtttattatttttaactttattattacttattttattttccttccacaatggtggtgcatgcctgtagtcccagcttctcaggaggctgaggcagaagaatcccttgaacccaggaggcagaggttgtggtgagccgagatcgcaccactgcactccagcctgggcaacagaggagactccatctcaaaaacaaaaaacaaaaaacaaaaacctcatactgtggaaggtttccgtctcaagtgtcttctacatttgtccaattttgtgttgaatattttgaaagcacccctgcatatgcgtgtatgtgggtacagagacatatgtgcaatgtgatccttcatgttggttatcgtaaaaaaacaaacaaaaaaacactttttagagttggacatccttctctggactgaggaaaagtgtacttattttggtagggatttgtgttcataccatagcaaagctggtataaagaagacggggagaagccgggcgcggtggctcacgcctgtaatcccagcacgggcaggcagatcacctgaggtcaggagtttgagaccagcctggccaacatggcgaaaccccgtctctacgaaaacacaaaaattagccgggcgtgttggtgccacctgtggtcccagctactcgggaggctgaagcatgagaatcacttgaacccaggaggcggaggttgcagtgagccaagattgtgccactgcactccagcctgggtgacagagcgagactccatctcaaaaaaagaagagggggaaaggcgaacattattggactttttataataactggtgggggtaaaaaatcaaaagtgcaataccattaccctttcttaatcaaatcctcacaaacagttaagtatcagtactgtaaacaaaatgcctattaccacttggggatttgaaattaaaaataatcttccataacttctgaattaatctgtttttagaaaattaataattttagttcttggagatagttgggtaatgttttccctttaggcctagagttctagctggagttactctggggcaggcagctccagaaatagccccgtgggtctcctctggggtccgggggcccctgaaggggcaggtttccactgatcctgtttcctgtcctaaggcagctttgaaatgaacacccaccccgaggaggacagctcaagtgtccgcaagaggggctgatttaaattacaggcattggttctcacagaatgctgtgtttacgttagaacaaagtgatgtttctttccttctttttttttttcgagacagggtctcactctgtcgcccaggctggagggcagtggtgtgatcctggctcactgcaacctccacttcctaggttcaagtgattcttgtgcctcagcctcccaagtagctggaaccacaggtgcacgccactatgccctgctaatttttgtatttttcgtagagatagggtctcgccatgttgcccaggctggtctttaactcttggcctcaagtgatccgcccgcctcagcttcccaaagtactgggattacaggcatgagccgacatgcccagccttttcttcttcttttcttttttcttagagacacggtcttactctgtcacccaggctggagtgcagtgacatgatcatagctcattgctgccttgaactcctgagctcaagcaatcctcacacctcagccttctgagtagctaggaccacaggtacatgccaccatgcctagctgatttttaaaaaaattttttgtagatatgaggtcttactatgttacccaggctagtccaaagatgaagatgattctatgtgatttgaccttttttgttgttgttattgttttacatttttttgtagagagagggtctcatactatgttgcttaggctggtcttgaactcctgggctcaaacaatcatcccacttcagcttcccaaagggggattacaggagtgagccaccacgcctggccatgatttcactctaaaacagtgcctactattacatatagtatgtgtgtgtgcaaatccataaagagcctttggcacaagcctggtccataataaagtcaaaaaatgttagcatttttatatatgtagttaagttaaaaagcaagttgaaatatagtatgatgcttttttttttcttttctgagacagagtcttgctccatcacccaggctggagtgcagtggtgcaatctcggctcactgcaacctctgcttcccaggttgaagcaattctcctgcctcagccttccgaatagctgggattacagccgcccgccaccacgccttgctaattttttatttgtttatttatttatttattttttgtatatttagtagagacgggggtttcaccacgttggccaggctggtcttgaactcctgacctcgtgatccacccacctcgacctcccaaagtgctgggattacaggcatgagccaccacgcccgacctgatcctatttttattaaaaatgtatatacatatatattggtatctgcatagcaaaaaccatttgaaggggaagtttgcacccagcagttagtggcagttctctctatgggagaggtaccattaaaggggggctttgtatattttttaaacattttaaacttttaaagttacacatatgtatcacttatgtggagaaaaagatgttgttaagaaaaataaagtaaaataaccaggtaacttcctcttcctcaaatacattgataaataccccctcctcaaaactcatcacttctggccgggcacggtggctcacacctgtaatcccagcactttgggaggctggggcaggtggatcacgaggtcaggagtttgagaccagcctgacctacatggtgataccctgtcactactaaaaatacaaaaattagccaggcatggtggcacatgcctgtaatcccagctactcaggaggctgagccaggagaatcacttgaacctgggaggctgaggttgcagtgagccaagatcgcgccattgcactccagcctgggcaacgagagcgaaactctgtcttaaacaaacaaaaaaaaaaaaaaaaaaaaaagcttcatcaccaggatgggagtgtcttctaggtccctccgctccaggacctttctaggctctgttcatcccctccactcacacacatctggaagctcctggaatgggcttccctttttcacacctctgccttataaaatttctttcaactgatgtcctggtctatcaaaattacagttctgcctccttcagaacccagctttaatttttatttttttaattttaaagacaaggtcttgctgtgttgcccaggctggagtacagtggcatgatcataactcactgcagcctctaactcctgggcttgagcgatcctcccacctcagcctcctgagtagctgagaccacaggcgtgcaccaccacacttggccaacttcttaatttttttttggaacgatggggtctcattacgttgcccaggctggtcttgaactcctggcctcaagcagtcctcctgcctcagcttcccaaagtgttgggattacaagcataagcgattgagcctggcccagagcccagattgaagacaacctttccaggctttctgctctgccttccgtggggctcttagcagacctttatgtgtgtgagtcattctccagtgtcgttctttgtttgagtcagcacctgactgcaagagtagggttgtgtctgatgcgacctccattcccttggtcctgcgtagtaggacttgataaaatgtttgactgtgtgtggacgggagttggcacttcattgcttactttctaggttatcgaaagcaggctctgttgggttagtgttgccaggggtggcttcagagggagacaacagctcagctttccaacctttgttccctcagcatcccataaacctaagtggttttttttttaacgcactgtgacctggaaacttggattgtttaaccaaaatggcccgctggcctccctccaaggaacacacccagcaggtattgggtgtggattgtgaaaggtcagattctatcgctgtcaagcccagccttctgcccaagctcccgtggagacgtggcagaaccattcagggggccgccctctccatagaatatcaggcagtcatccaaagatgtttatagagtttatgataacgtgggaaagtgcctctgctccagagttaaatctaaaaagaatacagcatgattatagctctgtgaaactcgcacgtacacatacagccaaggcctgaggggaagcacatcaccagggcagcaggaattgtctttggattggattaggagggactgtgttccttttctccttctctgtcatttctacattttctagaataagcatagggagcaaatacatgtttttaatttgttattaaggtgggaaattttatttttaaatattattttcagccaggtgcactggctcatgtctgtaatcctaggacttttggcggccgaggcaggtagatcacttgaggtcaggagttcgagaccaccctggccaacatggtgaaaccccgtctctactaaaaatacaaaaaaaaaaaaaatagccgggcatggaggtgggcacctataatcccagctactccacaggctgaggcaggagaatcacttgaacctgggaggcagaggctgcagtgagagattgcaccactgccctttagcctaggcaacagagcgagaccctctcccctgccccctggcaaaaaaatattttcctgatctgagaatatctcagagctcattccacatcaatacacatagatcaccttatttaaaaaaatttcttttgagatagggttgcccaggcagaagtgcagtggtgtgatcatagctcactgcattgaaatcctgggctcaagtgatcctcccacctcagcctcccgagtagctgggaccacaggcatgcaccaccatgcccagcctgttgttggttatttaatggctgaatatcatttcattgttggaagcaccataataaatgtagccagcccctccttgtagggtatgtaggttatttccagtcttgtcctgccacaaacagcacttccttgtgcatgtgtctttgcacccatgaatgggcgtgcccaccagaggaccccccccagaggtgaactggctaggcaaaacgtttgtgtgtttaaactgggataggtgttgtcggttgctcctcaaagaggttacaccatcgtgtgtgccccccatgatgggtgggtacacctgcttcccatgcccttatttggccaactttggtgattacactcatacttgtaacccactgagggcagctctaacagcatgatcaaagaataatgattgccttgggaggccgaggctggtggatcacctgaggtcaggagttggagaccagcctgaccaatatggtgaaacttcatctctactaaaaatacaaaaattatctgggcgtggtggtgtgagactgtagtcccagctactcaggaggctgaggcaggggaatcacttgaacccgggaggcggaggttgcagtgagccaagatcgcaccactgcactccagcctgggcaacaggaaaaaaaaaaaaaaattttagcagtttttggaaatataattcacatgccatacaatttacccatttaaaatgtactattcaaagcctttgagtatattcataaaattatgcatccatcaccacaaccacttttagaacattttacccaaaaactaaattctataccccttagccatcacgctctaatatacacatcccacccagccccaggcaaacaccagtccactttctgcctctctggacttgccttttctggacgttttacataaatagaatcatacaacatgtggccttttatgtctggcttcttttgctaagcataatgttttttgttgcttttttttttttttttttttttaggggcggtttcactctgttgcccctgctggagtgcagtggtgccatctctgctcactgcaacctctgcctcccaggttcaagtgattctcttgcctcagcctcctgagtagctgggattacaggcaacatggtgaaaccccatctctactaaaaatacaaaaaattagccgggcatgggggcgcacacctgtagtcccagttactggggaggctgaggcgcaagaattgtttaaacctgggaggcagagattgcagtgagctgagattgtacaactgcactccagcctgggagacagagcaagactgtgtctcaaaaaaaaaaaagtgcagatattttgctattaagatcttagtgtatagttcagactttactgtatttcactttaaatatacacaaatatggacattttgttgctactgtagaatcatgctatatatgtcttcagtaaccagtttttttcggcaagcaagaaatcatcatgtcttttcagatcagtaaatatggatgtagtgtcttgatggctctgtcagcccattgtatggctacaccacagtttctttaagcattgcctcttgtgggatacttaggcagtttccacgtttgtttgtttttgagatggagtttcgctcttgttgcccaggctggagtgcaatggcacgatctcagctcactggaacctctgcctctcgggttcaagtgattctccagcttcagcctcccaagtagctgggattacaggcatgcaccaccacgcctgactaattttgcattttttagtggagatggggtttctccatgttggtcaggctggtctcgaactcctgacgtcaggtgatctgcctgcctcagcctcccaaagtgttgagactacaggcgtgagccaccgcgtctggccagtttgtttgttttttaagagatagggtctcatgctgttgcccaggctggagtgcagtggcacaatcatgggtcactgtagcctcgacctcctgagctcaagtgatcctcccaccccagctccccaggtagttgggactaaaggcatgcgccatcacgcctggctaatttttgtatttttttttttgtagaaatggggtcttgctatgctgcccaggctgctctggaactccaagtgtcaagtgatcctcctgccttggcctcccaaattgctgggatcacaggcatgaccactgtgcctggtttccagttttttgctgctgtattccatgctgggttccactgataattgtaccaaacctctaagtgcatgtggcatagattgtggcctctacacaccactgttggtctctttccattccagagcctcactgtgttcccccacttcttcccgcttcttttatttgagcccttgagtttggttaagcccattactgctctgcaggaggggagagtagttgggctgtctctgagttgtatttctttttttttttttttgcctcgacttcccaggttcaggtgatccttccacctcagcctcctgagtagctattactacaggcgcatggcaccatgcctggctaattttttgtatttgtagtagaggcagggtttcgcaatgttgcctagacttctgagctgtatttcataaagtctgcagaagtgatgatggggaaaaaaatgattttataacatgaagtgactgtaacaggtgataaaggcttgggtgagtcactggatgtgtcctcaagtaaccaggggccttgattactgtgataatggcaataataacagtaatataaaattggcaacaacagtgataacatcccacgtgccaaaacatttgcaaacacattgccggcactccaccctcactcctggcatactcgatgaagtaaattattattactatagtaatcattattattatttccatctccctttcctggtatataattattatgatttcactattatttatttttattttgtactctcagactttgaagaaccacagcctttctattctgtagccagaattatgttttcctttttttatgaaatatccacagacctcttttttttttttttttttttttttttttgagacagagtcttgctctgtcacccaggctgtagtgcagtggtgcaatctcagctcattgcaacctccacctcctgggttcaagcgattctcatgcctcagcctcctgagtagctgggagcacaggcacacgtcaccacgcccagctaatttttatattttttgtagagagggggtttcaccatgttcaccagactggtctcaaactcctggcctcaagtgctccacctatgtcggcctcccaaagtgctaggattacaggcatgagccaccacacccggcccatagccctctgttctatgtaagattaattaacctactcaacaactgagttccggaatccttagaaatagaggatattagagctggcacggccttaagaatcatctaacctggccaggcgcagtggcttatgtctgtaatcccagcactttgggaggccaagacaggtggatcacttgagtccgggagtttgagaccagcctgggcaacatggtgaaactctgtctctacaaaaatacaaaaaattagccaggcgtggtggcgtgtgcccataggcccagctacccgggaggttgaggtggaggttgaggtttcagtgagccatgattccattactgcactgcaggctgcgcaacagagtgaaaccctgtctcaaaaaaaaaaagaaaagaagaaaactcgtctaacccagtaatttttgtttcttaactttgatttacacaggcattacctaaatacattctcattgtaaaaagaatgcaaacaacatagataaactgaggtctctttgagcaacttcttatccctttctattcccagagataagaattatattagtttcatataaattacttttcagacctctttttgtgcatttgcatataagtatacatttgtgtgtatgtctacagacacacacatccttagaaaatccatggtattgatttgtgggtttccgccaccagtaagtggtatcatagtgtttgtattgttctgtaacttgcttttttcccccctaaacaataggtcttagaaattgcccatgctgggtgcggtggctcacgcctgtaatctcagcactttgggaggccaaggtgagtggatcacctgaggccaggagttcaagaccagcctgaccaatatggtgaaacctgatctctactaaaaatacaaaaattagccgggtgtggtggcactcacctgtaatcccagatactcaggcagctgagacaaaattgcttgaacccaggagacggaggttgcagtgagcagagatggcgccactgcactccagcctggacgacagagtgagaccacgtcccccactccctgcccggggggaatacaaagatcacccgtgctagcatcttattttgagtataccaagtgtatgtgatcatccccctacagatgggcagtttgtactgcctgatcattatggcattataagtgctgaccttgaggctagagttcaagaccaccctggacaacatagagagactgtcatctctacacacacacaattttttaaattagctgggcatgatggtgagcacccatagtcccagctacctgggaggctgagttgagaagattcgttgagcccaggagttggaggcttcagtgagctatgatcccaccactgcacttcagcctaggcaacaaagtaataaatacctggtctcaaaaaaaaagaaaaaaggaaaaaaaaaaaaaaaaaaagcactgatcatccttggaccagcttacctggacacacctgggtaggtgataggaatggctgggtcagaagtcggtgcagaagaaggttcatagccactgccaggtggctctcaaagatggcagtacctgcttccattccccacctgatggtaacattactggtgatttgtagctccagcaggagtcacccataataagcactgccaccccagtgagccactgtttttggtgggagtgtgtctaccctgggtgcaggggccacaaaaaagtggaccaccagcagccaaaaccttcttcatccttgtttgtaaacaaggaaatggaggttcccacagccagtcagtaagctggaaccagagtcagggacatgaatgttagtacagtactttttatactgtgcttattaaaaaaaaaaaagtcagttgcattaatcccacctgttgccaataaggtctggcatgactctgttctgggtttggaaaaaaggtaatttttattctatgaaataccacaccctctaattctgcagtactttcctccctgttttgtggttggtgccacggcatccagccaggaggtaatttctgttgctaatcttcactgaatggggacggtccctgttagtggcttacggagtggcggagtcgtttgagagaggcactgtcagagaattgtgtgtcgtagacagagaacagggcacctgtacagacatgcttggaagggtggcctgctgaattctcaaccctgcaggctctcctgacaggtggaggtcgaaggctgtccctgccatttgtagcagccggaatatgagctgagactggtgctttaagttacggggattgggctgggcgtggtggctcatgcctgtaatcccagtgctttggaaggacaaggcaggaggatcacttgagcccagaagtttgagaacagcctgggcaacataccgagatcctgtctgtacagaaatttaaaaaattagccaggcatgatggcaagcgcctgtcatcccagctattcgggaagctgaagcaggaggatcacttgaacccaggagtttgaggctgcggtgagctgtgatcatgccactgcattccagcctgagtgacagagcaagaccctgtctctttaagagaaaaagtacaggggccaggctcatgcctgtaatcccagcactttgggaggccgaggcaggcggatcacaaggtcaagagatcgagaccatcctggccaacatggtgaaaccctgtctctactaaaaatacaataattagctgggcgtggtggcgcaagcctgtagtcccagctgctcaggaggctgaggcaggagaatcgcttgaacccaggaggcagaggttgcagtgagccgagatcatgccacttcactccagcctggtgacagagccagactccatctcaaaaaaaaaaaaaaaaaaaaggtacagggaccgaaattcagaaaaatgttttagacatacacatgtctgctgtggggttatttacaacagggagcaatcagtgacaagcttgaagtctaacagtggagagcaacaggtgaataatcaagtcaataacaaaaaagttatacagtagattattatgcaactattaaagcaggatgcaaataacttataaattttatagttatctgatgtactgtctgtgccaaaagaattttagtgatttgtttactgcttcttggagtataacttgggataaattttttggcagagaactcagtcatttctagattttaaatgtgatccagcagttacatttcccaaaaaatatgtactactgagatcttgcacaagcgcccaagatttggataggaagatgttcacttcagcactgtttgtactaggaaatgttggagggaacccaaacattattcaattggaggttaggcaaataccttaaggtacatttatataattatatatctggtagttctggaaatgaaaggaggttaccccagccagtctgcacatatgacatggaaagatgtccaagatcttacattaagaaaagtcagatgcacaacagaacatgtggtgtggtccaattgctctttctttttattttgttttatttttatttttttgagatggagtctcactgtgtcgcccaggctggagtgtagttgtgctctcttgcctcactgcaacctccgcctcctgggttcaagcgattctcctgcctcagcctcccaagtagctgggattacaggctcgtgccaccatgcccggctaatttttgtatttttagtagtgacagggttttaccatgttggccaggctggtatcaaactcctgaccttgtgatctgcctgcctcagcctcccaaagtgctgggattacaggtgtgagccaccgcgcccggcctaaactgctcttaaatatgtgtttatgttcacagaggcataggaaaaaattttgcagaatgtctacatcaactgtcagctgtggttttcagaggaagtggattagggaggacttccgctttctaattcagagttctatagtgcttgcagtttttatgtgatgtggatcatactttggaatcagaaaaaaaaattgagatcactaaataaagcacaaaatcccattgacccactcttctgtaaggaggtgaattatattttatggtatgataccaatcttattaaaaaatgcatgtaggccgggcaaggtggccacgcctgtaatcccagcactttgggaggccaaggcgggtggatcacctgaggtcaggagttcgagactagcctggccaacatggtgaaaccccgtctctactaaaaatacaaaaattagccaggcatgttggctcacgcctgtaatcccagctactcaggaggctgaggcaggaaaattgcttgaacccaggaggttgcagtgagctgagatcaccccactgcactttagcctgggtgacagagggagactgtctcaaaaaaaaaaaaaaaaaaaaaaaaaacatatagaagatctggaaaagaattagtctacggcattgctccagtggatggtatatggtggatttgacttttgtcttctgtattctccaacttttaaattaagtctaaattagctaccaaaatagaagaaaagaattacaggctttattttttgaactctgcagaggtaaaaaagccccagcaggctaggtgcagcagctcatctctgtaatcctagttccttgggaggttgaggcaggaggatcacttgaggccaggagttcgagaccagcctgggcaacaaacgtagtgcaacccggtctctgcaaaataaaaataaaaataaaaaaattagctgggcatggtgacacacaagtgtagtcccagctactcaggaggctgaggcaggaagatcgcttgagcccaggagttttgaggttgcagagagctatgatcacactaccaccacgtagcctggacaacagagagagaccttattcctatttaaaaaacaaaacaaaaacccaaaaacaaaagaaagccctagagagagtgagaggcctgggctctgtgtgtgtgtattggaaggcccagctccactgcctgagctgcttctattttgagcaggacccagtgctggggatgaggtgaagccctgtttgggctgagtccttgggaagctggactcttttttttgggtacagagtcttgctctgtcacccaggctggagtgcagtggcctgatctccattcactgcaacctccacctcctggttcaagcgattttcctgcctcagcctcccgagtatctgggattacacgtatgcacccagctttttttttttttaaagtagagacggggtttcaccacgttggccaggctggtctcgagctcctgaccttggatgatccatctgcctcggcctcccaaagtgctgggattacaggcgtgagccaccatgcctggctactctcaataggttttgatagatttgggagttcttttgggccatcataatgatggggtggtgggcactgctggcatagagttagggaaggccgggaatgccagcaaccctgaaacagggctgttctgcacgatgaattttcctgcatcccacaagatcttggaacagctcatgggaatcgtttcataattatctgaggccagagttaaatgctatgttatgtgtaaaggcggcgtatcctttgggaggctgaggtgggaggatcgcttgaagttcaagaccagcctgggcaatatggtgagaccctgtccctacagaaaattaaaaaattaaccaggtatggtggctcagcctggggtcctagctactcaggaggctgaggcgagaggatcacctgagccgtgatcatgccactgcactccggcctggggacagggtgagaccccgtctcttgaaaaaaaaataaaaaataaaaaaggcaacatatctttggcatggttctagctctgagcttagaaatttatgttatctatgaatttcacatagggcagtaaaatggggtgttatataatatttattataaaaagaggtcattgggtctggtaaggtcaagaatctccaccagagatgcagcctattttttttttttttttttttctgagacagggtctccctctgtcactcaggctggagtgcaatggcacaatctcggctcactacaacctctgcctcctgggttcaagcgattctcctctctcagcctcccaagtagctgggattacaagcgtgtgccaccatgcccagctaatttttgtatttttagtagagacagggtttcaccgtgttggccacactggtctcaaactcttgacctcaggtaaaccacctgcctcggcctcccaaaatgctgggattacaggcacgagccactgcacccagcccagcctagaaaagttttatacccccgatggtgtgtgagggtacccgttccctgatatccgggccagcactcgctaaaatgtttcatctcattaaaataattgccagcctgctgtaatcccagcactttgggaggccgaggctggtggatcacttgaggtcaggagtttgacaccagcctggccaacatgacgaaaccccgtctctaccaaaaagtacaaaaattagccaggtatagtggtgtgcacctgtaggtccagctactcccaaggctgaggtgggaggatcgcttgaatccaggaggcagaggttgcagtgagccgagattgcaccactgcactccagcctcggcgacaaagtaagaccctgtctcaaaaaaaaaaaaaaaaaaaaagaggccgggcacagtggctcacgcctgtaatgtcagcactttgggaggccaaggcgggtggatcacttgaggtcaggagttcgagaccagccaggccaatgtggtgaaaccttgtttctaccaaaaaatgcaaaaagtagcagtgcgtggtggcgggcgcctataatctcagctacttgggaggctgaggcatgagaattgcttgaacccgggaggtggaggttgcagcgagccaagatcacatcactgcactccagcctgggtgacagagtgagactctgtttctatatatatatatacgttatattctgtttctatatatgtattgtgtgtgtgtgtgtgtgtgtgtgtgtgtgtgtgtgtgtgtatatcctatataatatatatataatgaaatgttagccaacctgaatgggggaatggtatcctattttcattctcaactctttgatccaagcgttgtgtagttaagatgtgccatttctgcccacagggaggctgtgcctgtgagtgcagataggttcttttggggactgtgttcctgaaaggctactagacaggagtctctctctgtcctgatactgtctgcctctccagaggaaataacagggcaggaggagtccacgctgtccccaaagcccctgacctgggcctgatgttcctaccttctcctttgccttccacaggaagcctggaagcacgcaatccagaaggccaagcacatgcccgacccctgggctgagttccacctggaagatattgccaccgaacgtgctactcgacacaggtcagcagcttgtgtggggtctcgaggagtcctgggggctatacgtccagcttctgttcccaatcagtgaggcctaagtactcttgggggtcaggggaagggagtaatcataacagcagctaatattggcatgctaatgcgtgcttaaggcccggtgcattacctcactgaatccttctcgtggttctcacaaggtacctattagacaggctagactgagctagtttttttaaattgttgcagatctctggccgggtgaggtggctctcacctgtaatcccagcactttgggaggctgaggtgggcagatcacttgaggtcaggagttcaagaccagcctggccgacatggtgaaaccccatctctactaaaaatacaaaaattagccatagccaagcgtggtggctggcacctgtaatcccagctactcaggaggctgaggcaggagaatcgcttgaactcaggaagtggaggttgcagtgagctgatatagcactgctgcactccaacctgggcgtcagagtaacactccatgtcaaaaataaaataaaataaaattgttgcaaatctctgaaacattttccaatatattgattgaagaaagtccatttataagtagacccacgcacttcaaacccatgtcattcaagcatcaactatacttgccctgggccggtgcaaactgtgcagctctggagagctttcctccctctgagcctaggggaggttaacctgccaggcctctgcttgtttttcccggtggaggcatcaggctctgggaaacctgttctcaccgagggtggggtgttctggagtctgccccggctgagaggtgcgctaagggaaacctccaactagagttaagaacacctcagcccggagggaggtttcaaactttagggatccattgagctgaggagatttccaccaggcaaacttgtgtgaggcctggccaggcccaggggctgatttactctgggaaaggagagatggaaatgttccctgaaccctctccaagctctctctgccttaggtatgcacctatctgtgacaaaaacaaacttaatttaacctactgtacccttacaacacagaatgcttctgtgagctcaaaatgtgtggcggtttctccccacccacaagcaagtaatcagctctgcagtggacaccagcagatgtgcgtctaattctgttcctctaattgaaggaattagaggagttttgagttgggtatcctatgattcaattcaattctgacaccatctacctggagatagcatcagatcccacaggttggaggctcagtcctacaagaccgtccccgactttcactgctgatcgcaagcccgaagtggtttcacctgtgcttctgaccagctataaatcagggttcccatgaacccctccttgggtttgattaacttgctggagcagctcacggaactcagggaaacacttactcatatttactggtttattataaaggatgttacaaagggtacagaagaagactgggcatggtggctcatgcctgtaatcccagcactttgggaggccgaggtgagtggatcacttgaggtcaggagttcgagaccagcctgaccaacatggtgaaaccccatctcttctaaaaatttagccgggtgtggtggtaggcgcctgtaatcccagctactcaggaggctgaggcaggagacttgcttgaaccctgggagacagaggttgcagtgagctgagatcgtgccactacactccagcctgggtgacagagtgagactcagtcttaaaaaaaaaaaaaaaaaaaaaaaaagacgtcactttggagattccaaggactttcagagttgcatgccaggaaatggaatctaaaacaaaatatatatttaccatcacacaacctggtactggggctcagaaaatgataccccaaagtgaaggcttcagaaatagcccctctctgatcatctcctgccctcctgtctctcaccccttgttgtctccttaagcaagccattgaaactagaattggccgggtgcgatggctcacgcctgtaatcccaacactttgggaggctgaggcaggcggatcatgagatcaggagtttgagaccagcctggccaatgtgatgaaaccccatctctactaaaaatacaaaaattagttgggcacggtggcatgcgcctgtaatcccagctactcaggaggctaaggcaggagaatcgcttgaacccaggagacagaggttgcagtgagctgagttcgccccactgcactccagcctgggtgacagagcgagactccatctcaaaaaaaaaaaaaaaaaaaaaaaaaaaaaagaaactagaattgcccttgcccactaccagtcatagaaactagaacccctttttcccaaagccagccataaagcttaaaaatattactctaggccaggcgcagtggctaacgcctgtaatcccagcactttgggaggctgaagcaggtggatcacttgaggccaggagttcaagatcagcctggccaacatggtgaaactccatctctacaaaaatacaaaaaaaaaaattagctgggtatggtggcaggcacacctgtaatcccagctactcggaaggctggagcaggagaactgcttgaacccaagaagcggaggttgtagtgagccaagattgctccactgcactccagcctgggtgatggggagattctgtgtcaaaaaaaaaaaaaaattctctaaccttacatgaattttctgtgcaatagctggccataaataaattatggaatgagaccctcattccaaaggggtcctactccatacacaagagaaggaaatgctataacagagtggccaagaagaatcgcaacaggccttgctggccaactcagtctgttaccattagctcatctcctttttgcccaatcacattgcttcacgccatccctgcttcactgaacctcagcataaaatcggattggttcttctgtatctttgagtcttcattctgaaggcttccgtgtcacataaaactggttgtccatgacccttatgatggggaggaaagagatcactcctttctacccgtacaccggcagcccttctcctgtctagactcagagacgggacccttaccctccactgtgtgcggctgttacttctcgggagatgtgcccagctgcctggcaagatcgagggcaccaccaccacctcccctccctgggccatgccgtttgttacggagaccagttatgatcagcatattatttattcagtcattcatccaccttgtatatttattttatgtatgtatttatttttatttttatttttatttttattttttatcttttgagacagagtctcgctctgtcacccaggctggagtgcaatggtgcaatctcggctcactgtgacctccgcctcccgggttcaagcgattctcctgcctcagcctcctgagtagctgggattacaggcatgcaccaccatgctcggctaatttttgtatttttagtgcaggcagagtttcaccttgttggtcaggctgatctcgaactcctgacctcatgatccgcctgccccagcctcccaaagtgctgggattacgggcgtgaaccaccaagtccggccatgtatatttattaagcatccacacacactgggtcctggtgactaagacagacatgggtctgcttttgtggggttacagtccagtgggagccccagatgcagaacaagccagtaaacagcacagcagtgagtgctggggatatggaaatgggggacatggtagagagggaacagtgggtttgaggaaaggattgagaccagtgtgttgggacgtgggagggagggacagtgtctccaacccaacccaggaggttggctgggctatgggccaaggtggagagtgggttggttctgaggtcagtggggagcccagaagggtctttgacctttagccagtgagaaacaggaccacgtgatggacgctgtgccccatggtggatgggtctctgcaggtacaacgccgtcaccggggaatggctggatgatgaagttctgatcaagatggcatctcaggtgagcagagcgttgagccccgtggggacagggctgagcaaagactttctgcagctaactttggtctgtgcacccttctctcccactcccactttatttaatttttgtaacttcgggggattctttgttattgtttatttattggttgtagccagcatttttttttttttttttttgagacagggtctcactctattgcccaggagcacagtggcacagtcacagctcactgcagccttgacctcctggtctcaagccatcctctcaccttagcctcccaagtagccaggaccacaagtacacaccaccactcctggctaatttttttattttttatagagacatgggttccactatgttgcccaggctggtctcaaactcctgggctcaaatgatcctcctgccttggccgcccagagtgctgggattataggcgtaagccaccacacccgtctctactaaaaatacaaaaaaggcttttgaagaaaaaaaaaaaaagataaaagactagaaaatagagtattccctgcatattgaagttaggattgctttatgaaactttgttttagtgtaatatacaatatacacagaaaagtgtacagcttgctgagttgtcacaaaatgagcacactgccttaacatcggcccgtatcaacaaacagaaggcaaccagcctggccaagcccctctcagtcactcctcccatacccacagggtaagcacccctctgaattctatcaccctagattacttttgcctatttttttgcttcatataagtgggggcatacaacaggtattcttttttagagacagggtcttgctctgctgcccaggctggggtgtaggggtacatgatcttgccttactgcagccctgaactcctgggctcaagcaattatcccacctcagcctcccgagtagctcagactacaggggtgcaccgtcacacccagtcaatttttaaaaatttttttttttttggagatagagttttgctcttgttgcccaggctggagtgcaatggtgcgatcttggctcatcgcaacctctgcctcctgggttcaagcaattctcctgcctcagcctcccaagtagctaggattacaggcatgcaccatcacgcccagccaatttttctatttttagtagagacagggtttctccatatttgtcaggctggtctcgaactcccgacctcaggtgatccacccacctcagcctcctaaagtgctgggattacaggcatgaaccactgtgcccagccttaaaatatttgtagagggaggtcttgctatgttgcccaggctggtcttgaactcctggcctcaagtgatcctcttgcctcagcctcccaaaattctgggattacagacataagccgctgctcctggtgctgcaggtgttcttttggtcaacattttgcattggttttcatcgctgcatggtatttcattgaaggaatacacctggttgatttttccagtatattgttgctggacacgtaggttatctccactttttttctcttacagtcagggctgggaaaacgtcctctgagatgcactgtccctcccccatcatcctgcccccgtggattcttcccctcagctggggtggaggaatgggggttccttgtcatcctggcagcctctgggttggaaggcctctatggctttggtgctgagacatagaagggagatccccagggatttcaggattgagatgaggcccagggcacccatttgataggtggcatgtaaggggagcacctcctgtcttagggtcccttttgggtggggcatggggactgataacactctgtgtggtgtctttcagcccttcggccgaggagcaatgagggagtgcttccggacgtaagtgactcagcctggctcttggggccctgcccagagtccccccaggctcctaagagctgaggcattgggacattttcagccaaggaatggagccaggggcctctgccttcttgtagcccaggttcctgtccatctagtctccctcgggccacacattgggcctggctgtgacgatgggctcaggaagaacagggaacaccccacttacctctgccctggtgttgggaggtcaagggaaatgggataggagacctttaacagtgacctttaatccccctgtcccagctctttgaaggatgcagaggggtggggacgtccttcttacctcctgcattttgttcctgctgccagccacccagccacatcagacagggtcttgctgtcctgaggaccagggctgtgtccctggtgaaccccagagtacccaggtaggccccctgttgcctcttcccacaggaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtgcgtggccccactacctgccccctttccatgccagggcagctgggcacagtgtctgggaaagagggccatggtgaatccctatttcaccttctttttttttttttttgagatgaagtcttgctctgtcacccaccaccaaggctggagtgcagtggcatgatcttggctcactgcaacctccatctcccaggttcaagcgattctcctgcctcagccaccccagtagctgggattacatacaggtgcctgccaccacatctggctaatttttgtatttttagtagagatgtggtttcaccatgttggccaggctggtctcgaactcctgacctcaagtgatctgcctgccttggcctcccaaagtgctgggattacaggtgtgagccaccatacctggcctctttcaccttcttaatagtagctaataacaaccactgtttactgagcatgatgaaccaagtcatttattttatttttattttttttgagacaggatctttcttggttgcccaggccagagtgcagtggcataattacagctcactgcagcctcaacctcctgggcttgaacaatcctcccagcttggcctcctgagtagctgggactacaggggtatgccaccatgcctagctaatttttgtattttctgtagagaaagggttttgccatgttgcccaggctggtttcaaactcctggcctcaagcaatccatccacctcggcctcccaaagggctgggattacaggcgtgagccattgcacttgttccagagtcatttattcctaaaaacagagctctgaggtcggaatgtttttatcctcaattacagatgggatctattagtcaggatttttgtttgcaaatgacagaaacccactcaaactgcttaatccgaaaagggaattcattgccttatgtaactgaaaaataatgctgccacaggcacggctggatgcaggattaaactgaggttgtcagaatcttcctccatctctggcctgggtgttcttctgggttggcgtcattctcaggcagcctctgcactagtggtagcactctggcccccagcaggcccaagttcttgttggaatgacaaaacctatttccccagaagttccaataaaagtcccagagctgcgtttcattggctctgattaagtcagatccctattgccgagccaatcacagtggccaaggggcaggaatatgcagattgggcacaccctagccatgtgcctgcccttagagctaggaatgtaggtgttccacccagaccacagggactgagactggaaaaggtgagattcccaagaaaaagcggaagaaagagctgggaatgtatattagtccgttttcacacttctgataaagacatacccaagactgggtaatttataaaagaaaaagaggtttaatggacagatagttccatgtggctggggaggcctcacaatcatggcagaaggcaaaaggcacatcttacctggtggcagacaagagagattgaggaccaagcaaagggggtttccccttataaaaccatcagatctcgtgagacttattcactatcatgagaacagtatgggggaaaccacccccatgattcaattatctcctaccaggtccctcccacaacacgtgggaattatgggagctacaattcaagatgagctttgagtggggacacagccaaaccatatcatagtggatactatgtctgctctttgggaaaccctgggctcaaagaggctaaatgacttccccaaccaggcagagctgtagccaggtctcaaatgcaggcttttcaaccccctgctaggttggcaccttcatttgagcccctagggtgatgagtgactgaggccaagcagaattccctgttgcctttcggcatttgaggaaggatccatgcctctgccctgcatgagcccacagctgagatcttccacagcttgagcatctactacatacaacgcacagtctcctgggtgtgcagaatttattgagcacctgctgtttgcagagcccttgatgaagcatacttgaggcaggcgcaagaagccacagtccccaccctggggggctgtggcttcctctgcaatttgcggccttccagcctggcctcctttctcttcctccacaagcttgttcctgccccaaaaccttggccctggctgtgggcttggcgggcatcttgtgtcaccgtaattcttgcatggctagctacttcttatagttcaggtctcagatcctgtgtcacctcctcagccagcccatctcagacaaccctaagaagtggtccctctgccccagtcacctctgtcacatcattctaactttttttttttttcctgttctttggagcagttagtatgtcattcatttagttaatattttaggtgcttctctcccctaaaggcagagattttattttatcatgttcactgctgtctcctagtgcctaggtgtccagtaaataatactgtggtaggcctggcacagtggctcatgcctgtaatcccagcactttgggaggctgaagtgggcggatcacctgaggtcaggagttcgagaccagcctggccaacatggtgaaacccccgcctctactaaaaatacaaaattagctgggcatggtggtgcacgcctgtaatcccagctacttgggaggctgaggcaggagaatcacttgaacacgagaggcggaggctgcagtgagccgagattgggctactgcactccggcctgggtgacagagcaagactccatccccaaatagtagtagtagtagtagtagtaacaataataataataataataataatgtggttgacttaagggagggagagagacgtggttgtttgagaaggtgctggttgtccactgtggctgtaccactgcccctcgcccagggagccctctggcccagcaggtggccctgctgtaagtttccttgtagggatgggaccagcctttgggcagaaccctctgagaaccgccgctccctgccttcccctcaggccggttctcagaacccattgaagccttgtttggggcaagttctcacctctcagatcaggaccccttcggcctctgcatctgttgtctgcatgtctggtgacccactctccatggatggtcgtttccttgggaaacctggacctaatcctcccaggaggtggcattgaggaggacatgggaaccaaggatgagtccttgtgtaacagggcaagaggtgcaagctagagtccctaatctcccctactccactttacaaaccatatgcactatttatacattttcttctgtgtacaaaattaaacatagactttataaaaacaaaaaaaattcggcaaggaatgtcaaagttccctataatttcccattgcagggagaaaactgctgtttagaggttggtttatatttctctagaattgtagctcctgataaaaatgagttgccaggcacagtggctcatgcttgtaatctcagcactttggaaagcccggggtgggggggcggatcacttgaggtcaggagttcaagaccagcctggccaacatggtaaaacccatctctactaaaaatacaaaaattaggcaggcatggaggcgggtgcctgtagtcccagctactcaagaggctgaggcagaggaattgcttgaacctgggaggcagaggttgcagtgagccaagatcgtgccactgcagtccagcctgggcaacagcctgggcaataaaatataaaataaaatgaaagcaaacattgcctggctcctttttgcatcaataagtttaattcacagactgagcctgagaccctctttatgcaggtaaagaaactgaggcacagagaggtgaaattcagaaatgttcccaaattcacagttttactgtaaggcatagtctaagttgcttagcaaacagacccacaaaatatgtgtggacacgaaatggtttctttttcacttgtgtggaggtcttgcattggtgggtggcttggggtaggcttgtttgtgcctcatctccttgaagccatctagagaactcgttcctttggtcttttttctctgccatcccctcaggggtttgccatggaccacataatcaattctggctcccaagcagagtccaccttacagggcaggctggagttacatcattgcaatgctcacttcccattggctgggcacagtcatgtggccacacttagctgcaagggaagcttagcaatgtcatccctagtgggtggctgtgtacccttttaaaactcaaaggaaaacagagctgagcacagtggctgcagcttgtcatcctaatgctctgggaggatgctggaagacaagaggattgcttgaggccagttcttgaggccagttcaagaccagcctaggcaacatagtgagacctcgtctctataaaaaaatttagatatgagccatgtgtagtgacacacgcctgtagtcctagcttctcgggaggctgaggtgggaggatcacttgagcccagaagtatgaggctgtaatgagccatgattatgacactgcactccagcctgggcgacagagtgagaccctgtctctaaaataaatttttttttttttaagacggagtctcactctgtcatccaggctggagtgcagtgacatgatcttggctcactgcaacctctgcctcctgggttaaagtgatactcctgcctcgacaccctgagtagctgggatttttggtacgcacaagcacgcccagctaatttttgtatttttattttattaattttttttttgagacggagttttgctcttgttgctcagggctggagtgcagtggtgcaatcttggctcactgcaacctctgcctcccaggttcaagtgattctcctgcctcagcctccagagtagctgggattacaggcatgtgccaccatgcctggctaattttgtatttttggtagagacagggtttcaccatgttggccacggttggtctccaactcctggcctcaggtgatccacacaccttggcctcccaaagggctgggattacaggtgtgagccaccatgcccagccttaatttttgtatttttagtagaggcaggatttcaccatgttggccaggctggtctcgaactcctaacctcaactgattcacctgcctcagcctcccaaagtgctgggattacagatgtaagccaccgtgcccagcctaaaaatatattttttttaattttaaaaaaattaaaggaaaagaggagattagattctgggcatcatcaggagctcctacaatagagagctagtaagtcatggagccagggtctgagcccaggcaggcgagttcctctgagccctccccttgccgcttctcagaggaggtgcgcctgggccctcccgcctgagcccactccccatcccaccaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggtgaggccgagctcacctccaccctctgcccaccacagcccttggggtgagatcctggccaggctcagcccctaaagaggaaggtccctgtgggcttggagtctcacccccagagaagcctcttggagcattcagaaggagacccgtcaccccatgacagcttctgtcacctaaggtggccacaggacctgcagcccaaggtccctgcccaactgaagaggcctttttcctttgtcttttcctctatataactccttgaagagaaagcccctcagcatgggcagaggcgtggccagtgcctgcacagacctcagcctgtctcttgacatctcgttttccttcctgtcccctgtaggccttcagccacttcacttttgagcgttccggccatcagctgatagtggtggacatccagggagttggggatctctacactgacccacagatccacacggagacgggcactgactttggagacggcaacctaggtacgtggggaaagccagcctgtttctgcagaaaccacgctccctgctaaaacctctgagttcttcgtacagccaaggaaacaggctgagacactgtacgcgctttttcaagatcatggagatgggagcctggatgtctgatgcctcccagcttggcacgttttatacctgccctggccatatgtatgaggcccaccactgcctgtcccccgtcacagagcaaagcaacactccagacacccccgctctgtccacaggtgtccgcgggatggcgctcttcttctactctcatgcctgcaaccggatttgcgagagcatgggccttgctccctttgacctctcgccccgggagagggatgcagtgaatcagaacaccaagctgctggtgggtgcccagtgtgaccctgcttggcctggcaggcccttctgctacttgcaaagcaagccctgctcccctgtgtggtgacagccaggtcaagcagtgcttaactgatgaataccagggctggaagcatctgtcccatccatgccccagcccgtcccctccagctcagtgcacaaagccctcctgagcgtccttccaatcgagcagctggtatctgcttaggttgggcccattttttaccagagtgaggggaacaggcacgtggagatagtgagaaggcatgtggtgtgtgtgtgtgtttgtgtgatgtattgacaaatgactgaactagtcttagacctggctctccaggcacctcaccaacatacctcccatcctcccattgctacttggaccagggacaagagaatgttgcaaagaccagcttgggatgctggacatagagtggaatgctttctccagctctgggctgtggaatgtggtcagtgctttaggggatactggcaggtcctctgagcctctgttccagatgccctttcttggaggccttaggtttaatccctgactgattttttattttttaagacaatatatcagctcctaaacaggcatgtttaggagctgtggatgaaggggtttcagggttagagggaacaacaggaagagccctttaattcccagagggtgtgtgcgtgacatgagtatccctattaatgtccctagcaatcagccaagaccatcttgagaggaacagaggaaaaatgtgggagcccccaagtaaggaccctctctgggagccggccacccctgctccgtcccctttcagagaactctggagacgagaacatgagcgacgtgaccttcgactctctcccttcttccccatcttcggccacaccacacagccagaagctagaccacctccgtgagtgacggttcggtccctagtcactgtgattggaggggacaggtggagcagagctaaaccagctttcatttatgttagaaaaatcagacatgctaatcgaaaaggttcatggccccagtggttttataggtgagtttcattgagtgaactttcaaaacagatcatccaaatgctataaaaacaacccctattgtaggaaacaaagtaacttttatcagtgtgttttatgaaaccagcaaaacctatataataaatttgacaaactaaaaaagaaaattatatcccaaccttatttaaaatttgtatttgtgtatagagaacaaaaaaaaaatctaaatagatattaacaaataaaaatagtactatgttaaaaggttcacctgtcacagttaaatagggatttcacaggaatctgagggttgttcaatgttagaaaagctatgaatgtgatattaatgggtcaaaggagaaaaacagaatcattatttctgacactgaaagagtggagtttgctgatgattcagatgagagtctgtaggaaaggatagaggcaagactgaccccagggtattggcctaaagagctggaggtcatgtattcagggaaagtgtgagcgggagcaggctcagagcaggagagcaagattttattgtttagttttttaatttttctcattttgatacctttgaaagagagaaagattttagtgtcaaacattaaagaagccctttagatgtttccactggaaggtctttggaatagtctggaacaggagtcaacagacttttttaaaaggtcagagagtaaatattttaagctttgcaggtcattcagtctctgcatttggagcatgaaagctaccatagaaaatattaagtgagtggatgtggctgtgttccaataaaactctatggatggtgaaatttaatttttgtcatccatttaaaaatgtaaacactgttcttacaaactataaaaacagacagatagatttggctgtagagggcaggagacagagatagggaaccaccaggagatggttggtgttttttttttgtttgttttgttttgagacggaatctctctctctgtcaccccggctggaatgcggtggcgtgatcttggctcattgcaatctctacctcctgggttcaagcgattctcctgcctcagcctcccaagtagctgggattacaggtgcatgccaccatacccagctaatttttgtatttttaatagagatggggtttcactatgttggccagattggtcttgaactcctgacctcaggtgatccacctgcctcggcctcccatagttctgggattacaggcataagacaccgtgcccagctgaagatggttttgaagctatctgaggcccacttcttgagccccaaatgtataaacgtctgttcttccttcacaactgcattttattgaggaccaagtggtggccaggcacatatgctaataaacacattacaaggataattgcattgtgacaaccctgaggacacacataggtgacaccacttggccagaatcatgtagctggcaaacagcagacttagaataagttctcaaggaagaactttagcctccaggtgctgataacattcttctccttttttgtgcctttctttaaagcttaaaaaaaaaaaaaggcttggtggcaggtatggaccgccctaggccgtgggttggtcttatgcatgttccagtagtggaaccaggacatgatgtctgtttctccctgcccagattggccagtgttcagtgacctcgataacatggcatccagagaccatgatcatctagacaaccaccgggtgagtgtgaagggagggaggctgcaggcttcagaccccagcaggggtaggagtggattcactcccagagtgaatcttcagcttcggaggtgggcagcctagcccaggcactgccaggagggcacagaatgggggaattagggaggatgcagatgaatgtcagcctccagtccaaggctgagctttcctctgagaaaaggtgggtcccttgcagttcccagagatggttagggaagagggactcccagtcagcaacaatgcgatcttgtagtaaatgccagtctcagctccaggtttggtttgaccccacatgtgttggttgtcctatagagccctaatactgggtcttagatgtgtaacacatagcacagtaagccatgtgttctagctcttcacacctagctctccagttagataaacagaacatttcctgaagctttgggttgacttggtggtaagaaactgaaggcatcttatctgcattctcacaaatgtatattatggcaaattataatactctctatgcttgtgtgtgtgtttgaaatatttcttagtaaaattggccaggcatggtagctcatgcctataatcccagcactttgggagaccaaggtgggcagatcacttgagcccaagaatttgaaactagcctgggcaatatgacaagacccccatctctacaaaaaaatacaaaagttagccaggcatggtggcacatacctgtagtcccagctactcaggaggctgaggtaggaggatctcttgagcctgggaggcagaggctgcagtaagccatcatcacaccactgcactccagcctgggtgacagcgagatcttgtctcaaaaaaaaagaaaaaacaaataccttttagtagaggctgggcgcagtggctcacgcctgtaatcccagcactttggcaggccaaggggggcagatcacttgaggtcaggaatttgaagaccagcctgaccaacatgccaaaaccccatgtctactaaaaatacaaaaattagccgagtatggtggcagtttcctgtaatcccagctactcaggaggctgaggcacgagaatttcttgaacccaggaggcggaggttgcagtgagcagaggtcgcaccactgcactccaacctgggcgacagagcgagactcagtctcaaaaaaaaaaaaaaagaaatacttcttagtagaggcggggtgtggtggctcacacctgtaatcccagcactatgggaggctgaggcaggcagaccacttgaggccaggagtttaagaccagtctggccaacatgatgaaacctcatccctacaaaaaatataaaaattagccaggcatggtggcatgtgcctgtaattccagctacttaggaggctgaggcaagagaattgcttgaacctgggaggtggaggttgcagtgagctgagatcacgccactgcactacagcctgggtgacaacgtgagaccctgccacacacacacacacacacacacacacacacacacagaaaagatacttcttagaagaataaagaaggaaataaaactattccgttactaattgtgcaggtgacatgcagagagagctataattcaatgttggtaggtacatggctgaagttttagagattctaaattataccagattcgctttcagaacagaactcagacctgggagaataaaaaatatgcccaactaggccaggcacggtggctcacgcctgtaatcccaacactttgggagtccaaggcaggcggatcacaagttcaggagtttgagaccagcctggccaatatggtgaaacctcgtctctactaaaaatacaaaaattagccaggcgtggtggcaggcgcctgtagtcccagctacttgggaggttaagacaggacaatcacttcagctcaagaggtagaggttgcagtgagctgagatcgtgccactgcactccagccagtgtgacagagcgagactccatctcaaaaaaaaaataaaaatgtgtggttttggttgagggcttatttgtattaaatattgttcccaatgctatatttttgtccgtgggtcatagcccttaaccagcctttgtttttctgcctgtgaagtgggtgagtcactctcagtaaagcacttcctgtgatccacactctcagaatgtaacagtgcatttcacccacacagcccttcgatgtaggggctataatgaatcccataactaaggacactgatgctcagagaagttaagcaactgcccaaggtctcagctggcaagaaataaagccaggatttgagcccaggtcatttggctgtagagcccaaggtccttactgttaccttatactgctccctcgttggccaggcaggtcttgaacttgtgtcctcaagtgatctgcctgcctcggcctcccaaagtgctgggattacaggcatgagccaccacacccggcaagggacagcaggagcagggtgttaggtaatgggacagaggggagaaagctaacagttggggtgttgagatgtcataaccatttccaggtgctcaggggaccaccaggaccctaaggccgtcttctctccacaggagtctgagaatagtggggacagcggataccccagtgagaagcggggtgagctggatgaccctgagccccgagaacatgtaaggaacccccaggaaatgagaccggtgtcacctgttgccttgtttatcctccaggaaaatgaaaactccccttcctggagggggaatatgagtgggtcctgagaagataacaagtaaattaataaagagtatttcaggccggtcatggtggctcacgcctgtaatcccagcactttgggaggccaaggcgggtggatcacctgacatcaggagttcgagaccagcctggccaacatggtgaaaccccgtctctactaacaatacaaaaattagcctggcatggtggtgcatgcctgtaatcccagctactggggaagctgaggcaggagaatcactttaacccagaagacagaggttgcagtgagccaagattgtgccactgcactccagcctgggtgacacagtgaactttgtctcaaaataaaataaaataaagagtatttcagataaagataaatgcaaagaagataaaacaggatcatgtggaccagtaacggggcaagtgtggaggcttagatataaggctgataatggctgacaaatcttatggtgaagtgggagtcctgggctgctgagcagagaggatcctgggtaatagctggacccactcataggcaggatcctgtgaggccccagggaggagggccttggaggtcagtttccttgggtagcctcccagcagcatcctggtgagggcaacctcagacagtatctgccatttagaggtcttaccctgtgctgaaatggagcctgcacatcaaggccagtcttgccaggacacctctgatctcagctttatgattgtgaataaagaacatgctggccgggcgtggtggcttatgcctgtaatcccagcactttgggaggccggggcaggcagatcacttgaggccagaagttcaagaccagcctggccaacgtggtgaccccatctcaactcaaaatacaaaaattagccgggtgcagtggtgcactcctctagtcccagctactcaggaagccgaggcatgagaatcacttgagcctgggaggtggaggttgcagtgagccaaggtcatgccgctgcactccagcctggaccacagagtgagactgtctcaaaaaaaaaaaaaaaaaaaaaaaaaaaagtaaaacagctgggcctggtggctcacctgcaattccagcactttaggagggcaatgtgagaggattgcttgaacctggggagttggaggcagcagtgagctttgatcacactgctgcactccagcctgggcaacagagcaagacccatgtctaaattaaaatataaactaaacatgcagtaggagctctgcccgttaccccagtggctttgtgttgggatcctgcaccatcaagtcagttccacctgctcacacacggagggggacagcaaggctgtgactgcaccagcgttgtcatccctgcctgtgacccagcatcccttctgcttggcagagaagggttccagtgtcacctgggaacatagggccaattttctgagataagggtcacctaggagggccaggctggttccagggaggagggctggaccagctctcaggagaggttcctgggaagaagcttgtcgctttggatcagtgtaatttcttcctccgttcagggccactcatacagtaatcggaagtacgagtctgacgaagacagcctgggcagctctggacgggtaatgcgccctgaggcacccttgtctctgcctcttccctgtctcctccaggctctgttgctgtttctcctgtctcatatctctgctgcctgcccatctgtcttgcacatgtgctaaaggaagattttgcaaagcagcaaatctgggcaaatgctctttgaacctctgcagggcaggatgctgggggatttgtggggaggattagagaagagcagctcagccccatcctggaggggaaatcaccacagggacagctcctgtcttaagtgcctgccatgaaggcacttcgcagtaatcagtttccttcttgcaaccacccagagagacaggctaatgtgactctcatccccattttatgtatgagaaaactgggctcttaagcaactttccccaggttaccctcgcttgtatgtctaacaagcatcagcaagtctgggaaagaccagctctgtgccccacccacccctctaagtgattccctcacacgctttgaactgcccatctttggagcctttactaaggcaagtctctttcctacctgcaaagtcctttctctccctctgtcatctctcttcaaatcctacctgctctccaagcctggatcccagggcccctcgtccaggagccttccctggcctccaccacaggcatgactctggcatctcccagaacactgattatttaccctgtggtattttgtagccagattaggatcttctcagttaggtatggaacagggttgctcaagcaaggcactactggcattctgggctgaatcgttccttgttgagggggctaccctgtgcattgcaagatgtttagcatgcaaacgtgcacacgcacagctgcctggctgtatcctgcaagagcctttggagggggcatctttggccaggagaaatgatgtgttttttaaacccatttcctacagcaacctgctgatgttgctcatgtcgttgtggtgccttgcagaggaaagcaaggggatttgctggaaggtctgaagtgggagtcttctggtgccttatatggggagctggcgaaggggttggtttagagtgagacccccacccccaaccaaatccagattggtaaatgatggggaagcgcttccttgagctgctgaaatctgttccactggctcttgaatgcatgagttgatggaatttgaatgattaaaattggagctgtattagccgggcatggtggtatgcacctgtcgtcccagctactcgggaagctgaggcagaagaatcgcttgaacctgggaggtggaggttgcagtgagccgagattgtgccattgcactccaacctgggcaatagagtgagactctgtctcaaaaaaaaaaaaaaattggagccatgttttgccaataaactttgacatcgtgagggttcactccccatctccctccagccaggctcctgtgtagtaggggctgctgacagctgtgatgctgcgtccacccccagcccctcgcttccctggccggttctttcccttcaggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtatcggcgatgcccattttggagccctgtctgcactaacctggagccccccagctccagcctctcctccgctaatcacttcctcccgcaggctggctgggcggtcttgggtgcggctttggcccgccagacagccaggccgacaccgtagtctgtgtggcaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggtgagcaggtggcggggacccagctgcaggtgggggtgggacttggtcaccctgtggttcacctgcctcccatcctggaagtcatgcattcacctgccttctatcctgaggtttatgcatgccacaaaaatgtcccaggcactggtttgggggcaggcccctccaagttagttgaaactggcagaatcgatctctgtctttggagagggaggggaaggtaagtcacgtttccaggtaataacgacatggtgtgatgggggaagcagaagacaccagtggaaacatgtgaggaagggctgtaactggggcctggaggggttggttcaggcttcctgctcatcagttctgtgtgtatccctagtggctggggcctggcactgagtagatgcttggtagagattcgtagaatgaacagatgaagggatacctacctcaggccagagtggtggcttaaacctgtaatctcagcactttgggaggttgaggcgggtggatcacatgaggccaggagatcgagaccagcctggccgacatggtgaaaccccgcctctaccagaaaaatacaaaagttagccggacgtggtggcacacacctgtaatcccacctactcgggaggctgaggtgggagaatctcttgaacctgggagacagaggttatagtgagctgagatcacactactgcactctagcctgggcgacagagtgagatcctgtctccaaaaaaaaaaaaaattgggggggatatctgctttcgacctgaaggcccaaagggagtgagccaggccaagtgggggaggtgagcagctcaggtagaaggaacagcatgtgcttaggcccagaggtgagagacaaggtgcacccgtgtagctagaggtgcaggagctgaggcagagctggagctgaagcagcagggtgtggacctgcagggaaattgcgtaggagcctgctgctgcttctgtccctggtccgtgagcagagggaggaaaggattgaatgggatctggcaaggcccaggcaaagtgatcttttcccaggagaagttgagaagcccttggcgggcacatcctcccatctgttcccatcctccccatcacgtgggccaacgttgcgcatggacaggtggcctaggctcattgtgggtgcaggacatcagctctccttgacgggttggtttggctgtggcccagtgggtgaatggatctcagactcgagggtgggaagatactccaaagtcctttatttatttagctttttgaattggtaattacattcatgtgattaaaaacttatttatttattgttttgtttttgttttttttgagacagagtctcgctttgttgcccaggctggagtgtagtggtgcgatctcggctcaatgcaacctccacttcccaggttcaagcaattctcctgcctcagactcccgagtagctgggattacaggtgcctgccaccgcacccagctaatttttagtagagacagagcttcaccatgttggccagactggtctggaactcctgacctcaggtgatctgcccacctcagcctcccaaagtgctgggattacaggtgtgagccaccatgccggactatttatttattttagagacaggttctcactctgtcacccaagttggagtgcagtggcatgactgtagctcactgtagccttgacctcctgggttcaagcgatcctcctgcctcagcctcctgagtagctcggactataggcctgagccaccatgcccgaccaaagaagtttttttttttaatttttaaatataaaaagcttaacgatgggtgcagtggctcacacctgtaatcccagcactttgggagatggaggcgggtggatcacctcaggttaggagttcacaactagcctgcccaacatagcaaaaccctatctctaccaaaaatataacaaattagccaggtgtggtggcatgcgcctgtaatcccagctacttgggaggctgaggcaggagaatcacttgaacctgggagacggaggttgcagtgagcagagatcacgccactgcactccagcctgggcaacagagcaagactccatctcaaaaaaaaaaagctttacagtgaaaaatctgccttccaccttccccacatcctctcattctttgaataataggtagccatcattattagttacttatatgtaattccagagtgtattcacttcctaggacttccttaagaaattccacaaaccagttggcttataacaacagaaatttgttctctcacagttttggaagctagaagtccagaaatcaaggtgtcagtagagccatgccttcctctgaaggcttgaggggagaatccttccttgtttcttcgggcttctgggggttgctggcaatcttcagcgttcttggcttggctcactgaaatctctgtctccatctttccctcgtgtccctatctccctgtttcttctgctcttgtaaagacagcagtcatataggatttagggcccacctaacatccagtgtgacctcatcttaatataactattttttttttttcagtcttgctctgtcatccaggctggagtgcactggcaggatctcagctcactgcaacctccacctcccaggttcaagcaattctcctgcctcagtctcctgagtagctgggaatacaggtgcctgccaccacacctggctaatttttgtatttttagtggagatggggtttcaccatgttggccaggctggtcttgaactcttggcctcaggtgattcacccacctcggcctctcaaaatgctgggattacaggcataagccacagtgcccagccagtataactaattatatcttcaaggaccctatttccaaatcagatcacattctgcatggacgtgaatattgggaggatattgttcggcccagtacacggtttccatatacaaatatgaaataggctcctattttcaccctgctttttcctccaaagttagcatcctacacacacactcctgaacctagtgtttttcacttgacagtgtcctgtggacattttacctcagtggtatagagatagcttcctgattctttttttttttttttaatttgagacagaatctcgctctgtcacccaggctggagtgcaatggtacaatctcagctcactgcaacctccaccacccggttcaagcaattctcctgcctaagcctcctgagtagctgggattacaggtgcctgccaccaaacccggctacttttttttttttgagatgaagtcttgctcttgtcctccaggctggagtgtgatggcatggtctcacctcactgcaacctctgcttccttggttcaagcaattctcctgccttggctccccgagtagctggttttacaggcacctgccaccacgcctggctaatttttgtatttttttttttagttgagacagggttttaccatgttggccaggctggtctcgaactcctgacctcatgtgatccacccacctcagcctcccaaaatgctaggattacaggtatgagccaccatgcccagcctaatttttgtatgtttagtgcagatggggtttcgtcatgttgttctcaaatttttgacctcaagtgatctgccttcctcagcctcccaaagtgctggattacaggtataagccaccatgcccagccagctccccgattctttttgacagctgcataatgttctgttatatgtgtggggcatacctgtgagctattgatggacacttgggttggctgtattcttttgatatcacaaaaattgctgtagtgactggcctcctgcataatgggtggaacctcatgaaactgctattttggaaggtcataaatggtagaatattggcagtttcttatggttcagtcagattacatcatttgacatgtgggcagggcgtcgcccaccagtttttgtttcatgatggtgagacaaaaacttagatggtgaggaggaggtttggttggaagagaggatttttcacttttttgtctctctctataatctctctctctatatatatgtgtgtatatatgtgtgtgtgtgtatatatatatacatattttgtttttcttttttttttttttttgagacaggctctcgctctgctgcccaggctggagtgcagtggcatgatcttggctcactgcaacctccgcctcccaggttcaaacgattctcctgcctcagccacccaagtagctgggattacagatgtgcaccaccacgcctggctaatttttgtatttttagtagagaagggatttcaccatgtgggccaggctggtctcgaactactgacctcaggtgatctgcccacctcggcctcccaaagtgctgggattacagaggtgagccaccacacccggcctttctctggaatctctatgctcattcagccagtggtgtgctggggaacatttgacaattgactcttggaggtgggaaggaaatgtgtgcccacatatatgtaaatatattaaattttgctaatttaaagaataagtaggctgggcatggtggctcacacctgtaaccccagcacttttggaggccaaggcaggaggattgcttgagtccaggagtttcagaccagcctgggcaacatagcaaaactccatctctacaaaccccccacccccaaaaaaacaaattagcctggtgtggtgcacctgcctgtagtcccagctacttgggagagtgaggcgggaggataaaaaccatacactacaggagtttgaggcttccgtgagctatgatggagccactgcactccagcctgggcaaaagatcaagaccctgtctcaaaaaaaaaaacaagaaaaaataatatgtggtatatggtttacaaataacaatgaaaagtaaatttcatatcatcaactctcacacaatacttgcactgatttttgcaaactcttacacccatagccaacctatggttgcaattgatggagaagtgtagttctgacataagtgagatgaaagtgaaattaacaaagacctatgttagaactggaacttcatttgcctctgatgtgagcgacctccttcctgaatcagatggtagttttaaatactggaaggatatttcttcaatttgctgtactcgtcacaatagaatagctacaggcatgacccgcttgttagtttcatctgcagtgttcatgttttccacgcctttcttacaatagaaaaaacagtacatcaaaccctgatttgcagcattgtctgctttctaccaggtaagttatatgtgacccagcagtttcactcatagccataaacccaaaagaataaaaacacactttcacacaaaaacttgtacacaaatcttcatagcagcattattcataatagccaaaaaatggaaaacaacccaaatgtctgtcagtggatgaatggataaacgaaatgtgatacagccatacaatggactattatttgatcataaaaaggaatgaaatattgatatgcgctacaacacagatggaccgtgaaagcactgtgctaagtgaaaagagtcgcaaaggaccacatattgtatgactatattattatgaaatgtccagatccagaataggcaatccatagagacagaaagtagactaatggaagcctagtgctgagcaggatgaggagagtaggggtagagggagattgacagttaagcggtatgagatttctttctggattggtgaaagtattctgaaattgactggtgatggccatactgttctgtgaatatactaaaaactacggatgtgtactttttttttttttttgagacggtgtctctgtcacccaggttgcagtgcagtggcttgatctcggttcactgcaacctccgcttcctagattcaagcaattcttgtgcctcagcctcctgagtagctgaaattacaggtatgcatcaccacgcctggttaatttttgtatttttagtagagacggggtttcaccatgttggccaggctggtctcgaactgctgacctcgaactgctgacctcagatgatccacccgccttgacctcccagagtgctgggattacaggcatgagccacccagcccagctgtgatgtgtacttatgatgtgtacttctgatgcagggcaggcaggccccacattggagcttagcccaggagggttttttgcttcacccagaaaagaattcaagggtgagccaaatgtagaagaaaacagctttattgaagtgtcagtgttatagcttaggcagtggtacagctccatgactgcttctacggaatagggctgccccacaggcagtgtgctgagattagcagcttagggcagttctgcagtcagatttatacctacttttaattgcatgcatattaagaggcggtttatgaagacatgtctagggaaagggtagtaacttctaggttgtggggccatagccatagaaacaggcagtaactctcaagtgttgccctgacaatggtaaactgacatgttgcacaggtgggcgtgtcttatgaaaagctgttttcccaccccatccctgttttagcttgtccttgatttgttccagtgtctgagccaagcctctggagtcaagtgccccctcctatctcacttctatagcctcccaacccggagctctcaaaaaacagggtgaagattgagtagtgagatcttggcagccctcgagtgtaagcctcattcactcttctttctccctctttggtttgtatcaacaggagacagaagagaacaaaaccaaaggatttgattacttactaaaggccgctgaagctggcgacaggcagtccatgatcctagtggcgcgagcttttgactctggccagaacctcagcccggacaggtactgcagctgtcacccaggaggagctggtaggaacctgggctgcaggtgggcgcttgtcctcggtatcagcacaggcctgggttccagtcttggctgccccatgaccagtccagcaaccatgggcaacttattttacctccctggcctcagtttcttcatattgtaaactgggagtaattatagcacctgtatcctggggttgtcccatgaagggtaaacgagatgctgactgtaacccttgcggtgcctggcacataaagcatgtggtatggctgggcgcggtggctcatgcctgtaatcccagtactttgggaggccaaggcgggcagatcacttcaggtcaggggttcaagaccaggcttgccaacatggtgaaactctgtctctactgaaaatacaaaaattagggccgggcatggtggctcacgcatgtaatcttagcactttgggaggccaaggagggcagatcatgaggtcaggagttcaagaccagcctgaccaacatggtgaaaccccatctctactaaaaatacaaaaaaagaaaagctggcctggtggcacacacctgtaatcccagctactcaggaggctgaggcaggagaatcgcttgaacccgggaggcggagattgccgtgagccaagatcgagtcactgcactccagcctggggtacagagcaagattccctctcaaaaaaaaaaaaaaaaaagataaaagtcatgtgatacgaggcagccattctaaccagtataggtaatgatttgcctgagaaaaaaatctgaaagactatgcagcatccaggtgagagtgggtatccctagataggattatgggtgattttaattgacttttcctacttattattatattttagaaacagggtctcactctgtcacccaggctggaggacagtggtgccatcatagctcactgcagcctctacctcctgggctcaagcagtcctcccgcctcagcctcctgagtaggtgggactacaggcatgtaccaccacacccagctaaatttttaaatttgttggagagatggggtctcactatgttgttcagactggtctcgaactcctgggctcaagcaaccttccctcctcagcctcccaatgggattacaggtgtgagccaccacgcctgactagggcaggtattttggctctattttttgggtgactaaactagttctgagatgtaaaggggcttgcccatggtcaaatatttagcaagtggcagagccaacttacatcttctcacccctcctctgatgtactgtctactggcatggaggagaggtaaacaaaaaagactgacatgattgtattaggtcaaatgtcagtgtatacatatggtgcccattgagtgcactggggaagcacatcatgcatggggcggggcctggagctgggcactgagtatttgcatctgtgctttctcttcctggcctttgtctaccttttatttccatttgaggtgataagtttttattgacttgtaaaagttctttatatattaaagctattaaccctttggtatacttttctctttattttttatttttattttttaattattattatttatttatttatttatttttgagatggactctcactctgtcaaacaggcttgaatgcactggtgcaacctcagctcactgcaacctccacctcctgggttcaagtgattctcctgcctcagcctcccaagtagctggtattacaggtgcctgccactgtacccggctaatttttatattttaaatacagacaagatttcaccatgttggccaggcttgtctcgaactcctaacctcaggcagtctacctgcctctgcctcccaaagtgctggaattacagacctgagccaccactctcagcctttttattttatttttgagacagagtctttctctgtatcccaggctggagtgcaatggcgcgatctcggctcactgcaatctccacctcccaggttcaagtgattctcctgcctcagcctccccagtagctggaactacagatgtgcatcatgatacccagctaaattttgtatttttaatagagacagggtttcaccatgttggccaggcttgacttgaactcctgacctcgggtaatcctgcctgcctcagcctcccaaagtgctgggattacagatgtgagccaccatgcctggcctattttttatctatttatttatttttgagacagggtctctctgtcacccaggctggagtgcagtggtgtgatcatagctaactgcagctttgacctgggctcaagtgatcctcctgcttaagcctcctgcgtagctgggaccataggcatgtgccaccctacctggctaatttttataattttttgtagagacaagggcttgctatgatgcccaggctggtctcaaactcctggcctcaagcaatcctcctacctcagcctcccaaagtgctggtattacaagtgtgagccgctgtacctggccacatttcattttaaaagacattttttttttcagatatgtctaccatagatagagggagggcacagatgccacataatgaccattgtttactgggtttggggacacactggtttttaatatttatttagttaaaatctatcaaaagtatttctttattgcttctgctctagtcatttccttattcttcttccttattcaaagcagttccaaccccacccatgcaaagaacattaattaagggccagctatgggtaaggcagggctctgtgcaggcccaaatttgcgtttaagggattcaggccccagaagttactatccaataggcgaaggagaaggtgctagaaacgccaaggaaggatggacgccctcgccaatgggatagcatcgggttggggtggacaggggtcagcgattaggcctttcccatatgttttcaggccaattttgctttgccctttaagaccagggaaggtcagagcagaaaggagataaacaatctagtctagtgtctcctagtcagtgttaaaaccgagcccagcatggtggctcatgcctgtaatcctaacactttgggaggctgaggcgggtggatcacgaggtcaggagattgagaccagactgaacaacactctgaaaccccatctctactaaaaatacaaaattagctgagtgtgatggcagatgcttgtaatcccagctacttcagctacttgggaggttgagggagaagaatcacttaaacccgggaggcagaggttacagtgagccaagatcacatcattccactccagcctgggcaacaagcatgaaatgccgtcttaaaacaaaaacaaaagtttgttgagcatgtcaccaataattttcaaatggtccattttttaaatttaacttttatttatttatttatttgagacacaatcttgctctgtcacccaggctagagtgcgatggtgtaatcatagctcactgtagtctcaacctctcaggctcaggctatcctcccgcctcagcctctcgagtagctgggaccatagccatgcaccaccatacccaactaacttgtattttttgtagagctggggttttgccatgttgcccaggctggcctcaaactcctgggctcaagagatcctccaacctaggcctcccaaagtgctgggatcacaggcatgagccatatctggccattttttaataagataaaataaagtcaagattatttcctgagcaccatcccagccagccacttgcttgctttttttcatttaccagacatttattgacactatgctgtttgccagaccctgggaatgcagtagacaaatacagcaaaatagacaagggtctcctgccttcatggggcttaccttctagtcaagggacaccatgataaacaagtgaataaggagaattaaagattttggtagttgtaagaaacagtgtttgggggcagaatctctaaagaggtgatatgtgagctgagattggagggatgatgagtgtcttagcctgttctgtgctggtaacagaatatctgaggctgaggaatttctcatgaacagaaatttgctggctcttagttctggaggctgggaagtctaatatcagtatgccagcgtcttgcatgggccttcttgctgtgtcatcacctggcagaagagaaggagagggagagcaggtcaagcacggtggcttatgcctgtaatcccagcactttgggaggctgaggcaggaaaatcacttgagtccaggagttcaagaccagcttgggcaacctggtaagagtgtgtctctataaaaaaattttaaaaattagccaggcgtggtgacatgcccctgtcatcccagctactcaggaggttaaaatgggaggattgctggatcccaggactttgaggctgcagtgagctatgattgtgccactgcactcctgcctgggcaacagagtgaaacgctatctcaagaaaagaaaaaagagagagcaaaagggggctgaactcgcccttttataacaaatccactttcctcatactggcagaaatccattcatgagggcagaaccatcaaagcccaatcacctctcaaagatcccaactcctaatacctcacaatggcaagcaaatctcaacatgggttttggaggggacacacgttccaaccagagcaaggagccaggtgcagaaagagttggaggaagaatcttccaaggtgagggaacagcgggtgcaagggccacagagcaggcaggagcaggcatcgttggggaatggatggcagccggtgagcctggtgcaaaggtagacaaacaggagaccgtcctggagggcagcgcctgtcagacagggccgcagagggcactgtggcagcaaggcagggacagcaagtcatcagacctattgcttctggaatgtttcacgagacccacaggccttcttacctgtgtcgctgtatttgctctttcctgatatactataaatagttactcacacggattacacccaaagaaaaagagccctccgccctgtttgctgtgtattctgtggtgcgtgggtttggctggaaactttgtgtgccctggctggtttggccatacatgggctgcagtaggaggagttgagggtcgacgggcagagctggaagtggagactcaactattctggggtgagttctgcattgtgctggaggcaattttacataacaaaattcacagctgtcccgcacagcagagcatacggtgattgccattagtgcagatggctctagaggcctctgcagaggaccccgcccccaatccacttctctacaagtcagagggcagcttagctaggacactcaggcattgctaatgctagctcatggctgcctctgtgtagactgtaaaaatgggccccttcctcaagggggtgtcctagctaagctgccctttactttcatctatgggaaaattgttgtaatatactgattttattaaggaaagcaacttgactcctctttttttttttttttttttaacacagggttatactctattgcccaggctggagtgcagtggcatgatcatagctcactgcagcctctaactcctgggctcaagctatcctcccacctcagcctccggagtagctgggactacaggtgtccatcaccacacccagctttttgtgtgtttattgtattttttaatttttgtgggtacatagtaagtgtgtatatgggttacatgagctattttgatatgggcatggaatgtgtaataatcacatcaggataaatgggatatccatcatctcaagcatttattcattgtggtataaacaatttctttatactcttttagttattttaaaatatacaattacattatttttgactatagtcactgtttttttgttgtgtttttgtttttttgtagagacacggtctctctacgttgcctgggctggtcaactgctctcttaataaatattggccgagcacagtggctcatgcctgtaatctcagcactttgggaggcctaggcatgtggatcactcgaggttaggggttcgagaccagcctggccaacgtggtgaaatgccgtctttactaaaaatacaaaaaattagctgggtgtggtggcgtgcacctgtaatcctagctactcaggaggctgagacaggagaattgcttgaacttgagaggcggaggctgcagtgggccgagattgcaccactgcactccagcctgggcaacagagcaagactctgtctcaaaaatgaatgaatgaatgagtgaatgaatatcacagtatgaaggtgcctcatagatgtattggccttggacaagataggtcgtgaaccataggtggtggccctgctgggatccctgacttgcccctcctgctggaaggccctcctcctgccaccctgttgccatggtaacctccacctttccctctgtatctcctggcaaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggtagggcctggcagacctgcccctgggctgcaacagggctgggcagggaggaacctaatttccattccactgggagttatttatgacaagatgacaggctgaatcttcttccagggaggggaatttatggagctagtatgaagatgaacattgttattttaatggttatatattacggctttgtagggggtttttgcaattttaaaaactgaattgagattttcataacaaaattcaccatcttaaagtatatagtttagtaggggggttttcctttcctttctttctttttttttttttttttttgagacggagtctcgctctatagcccagactggagtgcaacggcataatcttggctcactgcagcctccacctcccgagttccagcgattctcctgcctcagcctcctgagtagctgggattacaggtgtgccaccatgcacagctgatttttgtatttttagtagagacagggttttgccatgttggccaggctggtctcgaactcctgacctcaagtgatcggcccacctcggcctcccaaagtgctggattacaggcgtgagccaccacacctggcccagagtttcactcttgtagcccaggctggagtgggccatctctgctccctgcaaccttcacctcccaggttcaggtgattcttgtgcctcagcctcctgcatagctgggactacaggcacacacccagctaatttttctgtttttagtagagatggggtttcaccatgttggccagactggtcttgaactcctgacctcaggtgatctgcccgcctcagcctcccaaagtgctgggattatacgtgtgagccaccatgcctggcctcctttccttttctttctttcttttttctttgaaatagaatctcactgtgtcactcaggctggagtgcagtggcacaatcatagctcactccagcctggaactcctatgctcaagcaattctcctgcctcagcctcccaagcagctgggactacaggcacttgcttccacacccagccaatttttaaaagttctttgtagtgacagagtcttgctatgttgcccaggctggtcttgaactcctagcctcaagcaatctgctgccttggcttcccaaagtctttggattacagatgtgagccactgcacctggtcctagtgggttttagtatagtcataatgttgtacaatcatcactgctatgtaattccagaacatttccatcaccccaaaaagaaatcccgtaccagttagcagtcctccccgaacctagcagccactatactttttgtccctatagatttgcctattctggagattttatataactgggagtatacaatttgtggctttttgtatctgcttctttcatttagcataactttttcaagattcatctgtgttgaagtgtgttatcagtacttcattccttcttattactacataatattccattgtgtggatatacagcctttatccattcatcagttgatagacaagttatatatatattttttctgttacataatgtattagtcttcttgggctgccaaaacaaaatactatagagtgggtggtttaaactaaaaaaattgctgggcacagtggctcatgcctgtaatcccagcactttgggaggccaagatgggaggatcacttgagtctaggagttcaagaccagcctgggcaacataggtaaacctcacctctacaaaagaaattgttttaattaactgagtgtggtggcacactcagtgagctatgatcataccaccgcacttcagcctgggcaacagagtgagaccctgtctcaaaaaacaacaaaaaaaattatttctcccagttctggaggctgggaattccaagatcaaggtgctggccagtttggtttctggcttgtagaaaacagctttctcactgtgtcctcacatgacctttctcctggatgcaagtggggagacagcaagagagctctgctgtctcttttgcttcctaaacgggaatgagctctgtgtgattagggccctacccttatgacctcatttaagctttatcacctcctcacaggctgctagaatatgaacgtcccctccaagtctcatgttgaactgtaatcaccactgtgaaggtgtcaagaggtgggactgttaagaggtgattaatgttgttatcatgcagattggtcagtcatcacaaaagtagctttgttataaaagcaaatttggccccctcttgctcgcttgctttctacgtctcttgctctttgccttctggcatgggatgatacagcaccaaggcctgtgccagatgctggtgctatgctcttggacttgccgggctctagaactgtgagccaaataaatttcttttcattataaattatctagtctgtggaattctgtcatagcaacataaaatggactaagacacagactgtgtgtctccaaatacagtgcagttacatcatgaatgaagagttcaacatatgaatttgtggatggggagcccagtggggacacagcattcagtccctaacatataataaacatactaagttcctaatttcacaggtataggatgaggctaagttttaaaagtttttaagttatattttaaaaattaacaaagaataatgcaaatctaggctgggcagtggctcgcgcctgtaatcccagcactttgggaggccaaggcaggcagatcacctgcggtcaggagatcgagaccaggctgggcaacatgatgaaaccccatccctactaaaaatacaaaaattagctgggcgtggtggcaggtgcctgtaatcccagctactcaggaggctgaggcaggagaatcgcttgaaccccagaggcagtggtgacagtgagctaagattccgccactggactccagcctgggtgacagagtgagactccatctcaaaaaaaaaaaaaaaaaaaaaagaagaagaatgatgcaaatctataatcttttatttgaaaattttaaatccaaaaagctccaaaaacctgaagtatatttgtatgttttacacaaattcacttggtaaaacctgacctagctgacatgaagctgtttgtaagtcgttatttcttccacttttgcacatccccacttagttctgcaaaagttctcaccctgattctcattggctcaaattagttctcagcctgattctcattggctcaaactcaatcatctacataccccaaaccaacagtagttgtttagatggcttactctgattggccatgactaaatctggaccaatcgctgtagcttggtgggggataggaggagtgctattattggctagattttatcacaggcccacctttagagccccgcccggaacacctggagggagagggcacacggagtagtttgagttcttaaggaaacgtcagggtgttcttctgggaggggtgatgggggacactgggctggcaaaaacaacaggtggttcacctctttttgcccccctttgctgtctttcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagacagagtcttgctctgtcacccaggctggagtgcagtgacatgatcttagctcactgcaacctccgcctcctgggttcaagtgattctcctgcctcagcctcccaagtagctgggattactggtgcacaccaccacactcagctaatttttgcatttttagtagagatggggtttcaccatgttggccaggctggtctcgaactcctaacctcaggtgatccacctgcctcagcctcccaaagtgctgggattacaggtgtgagccaccatgcctgcccattttgtggttctattttcatttttatttctttttttttttttgtcacgagatataagaaagtgctttttgccttgaatggacaattttagggctgtgctcactagtcttttcaggctggactgaaatgtcgggcccatggagccctgtgttttgtgcatcgggatgagaaatgaagcacttcacgctggctttcctaagtcacggggcgtgtattgccgtggcttagtgcaaagcattctttctcagagcatttagaggcatgcgtggcattttttcagtgggtgtgagattgcacaatacccaggctcccttctactgtggggaagggcctgcatgttggctgttttttaaacttctagttcaatttccttccataatgctactgattttctggcatacagccgaattccatcttttaagcatgctttctacggtgggcttttcaaaacaggtttgagttttgtatgcacacgtttactacctctaactcctacatcagctagtgtggaagagggtgcacctcaaagcttttacacgtaaggacagcggcttggaatgtgagagccttttctccaagcagacccacactctgcatctcagtggcagctcccacaacgtgactgcaatgtctcttatacagtattccttggtgttttcttagtgtctggatgttcttacgtgaaatctgctccccagccctggtccttggcattttctgcttgaagctgggctgattttcttgtaatttacagcaggacgctttcagcagcagtctcttgggattttatctaagatgtttgaggatgagagggcaagaactataaacactcattaattctagtagtctccccatggccagacaatggcgattgttatttaatgagcttttcctttcaatggaattcagctctcacattagtatgatttcatttgatgtttcaaatagcaaagatgctaggtgcggtggctcccgcctgtaatctcagcactttgaggagggccaaggtgggaggattgcttgagctcaggacttcaagaccagcctgggtaaacatggcgagaccctgtctctaccaaaacaacaaaaaaaagacagactgctttgatcaaccctaaatgcaaaagcagcctatttttctttgtttaaaagtcaaaacataaaaaagcagagtataacatacaaaccattcttaactattcattaaaatgggtccttcaacaccttagtggggtttgttgttgttgcttatgcagagagattattttctttttattattttataatttttgaaatagagatggggtctcactgtgttgcccaggctggtctcgaactcctggacttaagtgagcctcccgcctcagtctcccaaagcgctgggattacaggcaggagccactgagcccagccaagacttcagtgttgactgctttggaggcacaaacccatgcaagcgttagttccaaagttcagtgtgtacccttaaatgaacaatgaagcaggtaaaattacccttgaaaaaaatcccttggaccacccataaatgacagtgactttttcaatatggactcatcatagccagttttccttttgaagttggaactgatcacccttttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattcagccagccccccctctctgaaattttattatgtaaataatttgtgttccctgatcactcgtttaagttcttagttgtatgtcatctcttctctagcaggaattggcaaacttttttgtaaaggggtagaaagtgaagattttaggctttgcaggccatatagcctctgctgcaaatgctcagccctgctgttgtaatgtaaaagctgccacagacactacatgaacacgaatgagtgtggctggtgttccaataaaactttatttacacaaacgggtggcccttttgggctgtagtttgtcaacccttgctctaacccttgactgagagctactttattaagccctgagggcaggagctatcccaattttgtgttccccagggcaccaaaacacagtgctttggcatagagtaggcactcaacaagtgtgtgaacagatggagagccagccctagtcagtgcactcaccctttgaggctctggttcctccaaacaatgattcgttgtctggattggctggaactgtcacccccgcaattctactccccacccacccatgtgaccttaatgtcagttgctggtctgttgctcttcggggagggagagatggcctggatacagagctaagcaaatgcttctttaagggcccttaaaagtgaaaagtaacttgcaagaggttgagatccttctgagctaggagaacttattccaccttcaaaacctagtttgggctgggtgcagtggctcacgccactttgggaggctgaggtgggcggatcacctgaagtcagctactcgggaggctgaggcaggagaatcgcttgaacccaggaggcagaggttgcagtgagccgagattgcgtcactgcactccagcctgggcgacagagtgagactccgtctcgaaaccaaaaacaagaaaaacccctagttttgtgccttctgaagatagttaggacatcttctttttccgcaaatgctggacatgccaaaaacctaacgcaaaacccaggacattccagcccaactgggacgatatcagagaccatcttcaagtgcaagaagcaggtgaaagcccaggaaattggcagagccaggattatcatccagtactttcatttcacaaatggagaaaccgaggttctgccagctagattttttttcacagtgtcactgctagcaagccactaagctggagctgggatttgagagctgctgctatttagaggatcttgggaataaaatttaaactggagtttaatggccctttcagttttgctataggcaagagaataaaatgaatgaatggataggtggctttatgggtgtaagaaagaagcgaaaaaaactcccaaaccccagtgttcctgaatatctgttctccccctgaccactctgggaatttatcaaatgcagctttgacctccaagccaagtaaactgctcttgttgctattttagtggtttttgtttttttaagacacaaggtctcactttgttactcaggctggagtgcagtggcatgatcataactcattgtaggctcaacctcctgggccccagtgatcctcctgcctcagcctctcaagtagctaaaactacagatgtgcaccatcacatctggctaatttttttttttttttttttgaggtggagtctcgctctgttgcccagattcaagtgcaatggcacgttttggctcactgcaacctctgcctcccaggttcaagcgattctccctgtctcggcctcccgagtagctgggactacaggcacctgccaccacgcgcagctaatgtttgtatttttagtagagacgggggtttcaccatgttggccaggctggtttcaaactcctgacattaggtgatccacctgcctcggcctcccaaagtgctgggattacaggcatgagccaccgtgccaagccacgcctggctaattttttaaaattattttttgcagagacagagtttcactatgttgcccaggctggtcttgaactccttggcctcaagtgatcctcccacctcagcctcccaaagcattggggttacaggcgtgagccactgcacctggccctgttttcatggcttttatttcctttcatcccacacatttgtctgcagtactagacatgttttacaaatcaacaagtttacacaagtatatgcagcttgttttggggggaaaggagacaaaatatgcatattttctgtgtggatttgtgcctcttaattgtgtttctagtctctaaggtgaccctttaacctactcaagatggggcccagagaagtggcctgcgttacagatttattttggcatatgtactaagttccattttctctttacaaataaagtgttttctttcttttctgtctcagactcaaatgtctcctggtttggaaaaaaaaaaaaaatggccaggcgtggtgcctcacgcctgtaatcccagcactttgggaggccgaggcgggcgggatcacctgaggtcaagagttccagaccagcctggccaacatgatgaaaccctgtctgtactaaaaatacaaaaattggccgggcatggtggcgcacacctgtagtcccatctgctcaggaggctgagacaggagaattgcttaaagccggaagatggaggttgcagtgagcccagatcctgtcattgcaccccagcctgggcaacaagagcgaaactccatctcaaaaaaaaaaggtgggggatcgggtgcggtggctcacgcctgtaatcccagcactttgggaggctgaggcaggcggatcacaaggtcagtagatcgagaccatcctgactgacatggtgaaaccccgtctctactaaaaatacattaaaaaaaaaaaaaaaaaaaagctgggcgtggtggcaggcgcctgtagtcccagctactcgagaggctgaggcaggagaaaggcgtgaacccgggaggtggagcttgcagtgagctgagatcacgccgctgcactccagcctcggcgacagagcaagactgtctcaaataaataaataaataaataaataaataaataaagctgctgcaggcaggggtcaacgagaaggctcataccccatctgaaaggggcagccatgattcaacttcaaatgattgccaccatgggaagcgcgggctcaatgttaccctattttccaatttttcaagagctgctgaaaacttttttttttttaatgcaaggccttctgttctttaacatttgtaataaattctaataacttttcaaagccttccagatttggctcgtctgctgtcagtttgctttagagaaagtattagaacctctcgtttcttcatttgctcatctataaaacatagagtttttctgtttgtttttcagacagtctcactctgttgcccaggctagagtgcagtggcaagatcttggctcactgcagcctctgcctccgaggttcaagttatcctcccacctcagcctcctcacgagtagctgggactacaggtgagcaccaccgcgcccggctaattttgaaggggggcaggttgtgtttcatcttgttttttcctttcttccagtggagacagggttttgccatcatgcccaggctggtctcgaactcctgggctcaagcaatgcaccggccttggcctcccaaactgctggaattgcaggcgtgagccaccgtgcccggcctgaagaataatttttaccattacagagttgtaagcttcagagaagataatacatggtaaagtgtttttttttatttttatttatttattttaagatggggtctcattctgtcacccgggctggagtgcagtggtgcgatctcaactcactgcaacctccgcctcccgggttcaagcgattctcccgcctcgacctccctagtagctggcatggcagtacaggcgcacaccaccatgcctggctaatttctgtatttttagtagaggcagggtttcaccatgttggccaggctggtatcaaactcctggcttcaggtgatctactcaccttggcctcccaaagtgctgggattacaggtgtgagccaccacgcccagcctaaagtgcttttttaattccaagcttaagaaaatcttggttaccagttgatcttttggttttaagctaattttttttaattttaagaaatttgaacattagtataactatgcatggtaggttgaacatacatatttaggtccacttgttcctaaatccccactgcaatgacaggaagtggattcttttgtttgtttttttgtttgtttgtttgtttttaaatagcataagccggtgaggatgaagagaaagaggattgaacagcaagttttgggtgctggaaagtaggtagactgtaattgaattaacagacccaagaagtctggatcctagatcagcagtagagaaatctgagaaaaacccaattttcattgctgaacaagtcctgcaaggctgagaaattggcacgaggaggcctggcaccgtggctcacacctgtaatcccagcactttgggaggctgtggtgggcagatcacttgaggtcaggagttagagcccagcctggccaacatggtgaaacaccatctctactaaaaatataaaaattagccaggctgaggcgggagaatcacttgagcccaggaggcagaggttgcagtcagccgagatcacaccactgtactccagcctgggtgacagaatgagactccatttcaaaaaaaaaaaaaaagattagagagaagttaataaagaaaacttttctgttggttttgttacagcatacgtcaaaattttattacagtcttgaccgggcgtggtggctcacacctgtaaccctggcactttgggaggccaagatgggaggattgcttgaggccaggagttcaagaccatcctggtcaacacagtgaaagcccatatcttaaaaaaaaaaaatcacagtcttgctgcaagtgtaaacccactgggaattcaaagatttatacttggtagggacattttctaaaaatttattttttattacagtctgcctatgtagattaaactgcacgctcttaagtatacaggttgatgaatttttacatttgtacacatctgtgtcttaacaacccaattcaagatattagaacatttgcaggcctacagaagcccccctggaccccttcccaggcaatacaccctctctccaccccgaaaaatgttggccactcttctgacctctatcttgatagagacattttctaggagaagaaaatgattagataatcactgttagacaaaatagaaaagaaaagaatgttccgttaaaggtcactgcactcttgactgacaaatgaccatcaactgagtgagtagaaagctagtttcccagtgtaaatctcaatgctcttaaatttcaaaagaaaaatgctcaatgctcgagcatttatcagaaatgctagtttctttccagaaggaggttcttacagaaagatatggtctcaggccaggtttgagagcattttccttttatgggagcaagggaggaaagaatggaggggatccaggactgagaccccacacccatttccactatccacagcctagtgtttatgatatagggacaggcacacaaagaatagtcggagtttcagcccatccctcccttgtcaggcatcccgctgctgagaccttgtaggtccaggggttctgatgcaacattctgcatctcttgctcattgatttcatgtctgattgtcatgagaaaactgtgtaaggggctgctggactgtaagaaactctcaaaagggtgctgtgccttccaggatcagctgtttccctgcaggcttcctcttaattaagcatcctgctcagtatgtgtttgtagaaagagacaagttgctccagaatgttctagcagaaatatctcagccttaggagttcaagaccggtcctggcaacatagcgagacccctgtctctgtgaaaaaaaaaaaaattttaagtagccaggcatggtgtcatgctcctgcagtcccagcaactaaggagactaagatgggaggatcattttagcacagaaggtcaaggctgcagtgagcaatgattgtgccactgcactccagcctgggaaacagagcaagaacttgtctcaaaaaaaaaaaaaaaaattctacacacacacacacacacacacacacacaaagacacacacacagcttcatttgagcctttgccttgcaagggggagggggttattgtttacagttgacaactaccaagtagcactgggctttagcagagaaagggaatttattacagtgataaagggatgcctccaagagtggacaacccactgggccttggaaagggtctggagctggaagccagaaaaccatcaggatttccctgactctgctcttctcactctctcattccctctttttctatacactggcttttgtctacctctccaactcacctcacagaatatagccatgcgaaatccccctttcttcctagttttagccagcctcagagactaattccaacgcaacacggtcaaattaacaaatcgggccgggtgcgggggctcacgcctgtaatcctaacactttgggaagctgaggtgggcagatcacttgaggtcaggagttcgaaaccagcctagccaacatggtgaagccccatctctaataaaaacacaaaaaaattagcccggcatggtggcgtgcatctgtaatcccaactacctgggaggctgaggcaggataattgtttgaacttgggaggcagaggttgcagtgagccgagatcacgccagtgcactccagcctaggcaatggatcgagactctgtctcaaaacaaacaaacaaacaaaaaaaaaacaaaatcagtaactcacggagtctcagttcacattctcaagagagaatttgattggtccaacctgaatcctacgtccactgaagaacggtagaacccactagccatggctgtgggggtggggcgtgcagcacaaaggtggctgccagggacccactctctggctggtcaggcagttcctagaaaaatcagactgggcaaagatgccagcaattatccttgactgtgaggatatttccttttggaaaatccagtacccaactcacaaacaaagtccttcctggtactaaaataccatgacaaacactcctattgacttaaaggggttattcctcattcagctttgaactccccacaatgcctaccctttgtcttcaatccatggctgcttctgtatttttttttaatgtcttgaagagcaacaaacttttctagcacaagaaaatctttgcatatcattacatatgttaaaggtagatggatggccaggtgtggtggctcactcctgtaattctagcactttgggaggctgaggtgggaggatagcttgagatcagcctaagcagcaaagcaagaccccgtctctacaaaaatacaaaagttagcccagtgtggtggcgcgtggctctagtcccagctacttgggaggctgagatgggaggatcatttgagcccaggatgtcaaggctgcagtgagctgtgatcataccactgtactccagcctgggcaacaaagcaagaccccgtctctctaaaaaaaaaaaaaaaaaaggtggtggatggagggggagaaaagccaggctaaggagggattgaagaggaaagacataaaatgcccaaatgttaggggtgtgtaccaactggatattagccagaaacttgaatcatggccctgaaaagtctaataccagtcaatgcaaaatgagaattctacttataaaagtgtgatttatatagtttttgatgtgtctaaagcatcaccagcgttcgtagagttcctgcctaattcccccattcagtcaccttaagcattgactccactccctgtgttgaacagaactaatggagaaagtaatccacgtaaatgacagagggaaagagaaacgatagagaatgatagaggacaaaaccttagatatgagggatatttgagatttcttacgccaataaatgtgaaaaatcaagtaatggggctttgttttcccagaaaacgacaacttgccaaagttgactcaggaagaaatagaaaaaaaaaaaaagtcatcaaaagtcatataatttggcaaaatggaaaaatatatgcatatctatatctatatagagagggtctcactctctcacccaggctggagtgcagcacctgaatctcggctcactgcagacttgacctccctggctcaaaggatcttcccacctcggcctcccaagtagctgagactacaggcacatgccaccatgcccggctaatttcttttcttttgttttttggtagagacaaggtttctcgatgttgcttaggctggtcttgaactcctggcgtcaagcaatcctgccacctcagtctcccaaagtgctaggattataggagtgagccactgagaccagcctattattaatattattattatataatactagggaaagtataaatatagaccagcaatttcatttctagtgtataccctagagaaatgtccatacgtaagacaaggagccatgtgcaaggatacttcctgccatattgtgtgtaatgacaaaaatttagtaacaacttaaaagttgtacatggcatggaatgaatgaattagatctataggcatcataacagacctcaaaaacataatgttgggcctggcacagtctctcatgcctgtaatcttggctacttgggaagctgaggtgggaggatggcttgagcccgggaggtctaggctacagtaagctatgattgcaccactgtactctagcctgggtgacagagcaacactctcttaaaataataataataataatactgttgaaatgagaaaagcaagttttaggatatcagtacaatgtgctaacatttatataagtgaaaaacatacagataaccattttagatattattcataaattttatagtaaaaatgtaagaaattattggaaagatacacatcaaattcatgacagttatagacaggggagaatgggagggggacttatttctatttgcaatggtctaataatttctatttgtaatagtgtgatctattttttatttatttatttatttatttatttatttatttatttatttatttgagaccgagtttctcactgtcgcccaggctagagtgcagtggtgggatctcggctcgctgcaacctccgcctcccgggttcaagcaactctcccgcctcagcctcccgagtagctgggattacaggcatgtgccaccacgccaggctaatttttgtatttttagtagagacgcttgaacccaggaggcagagattgcagtgagcggagatcgcaccactgcactccagcctagacagcaagagcgagactccacatcaaaaaaaaaaaaaaaaaaaaaaaaaaaaaagaaaagaaaaaagaaaaggaaaaaaatgccacaatactaagtcattaatttaatgccaggtggtggcactatggatgataatttttttctttgtaatttttgtgcatttttgtttttaatatctttgcatatccacacggataggtattttaaaatacagtctggtgaaaaataacagccaattgcagatctatatgaataatgtgacaatatttgtgttcaaatccatacacaataaaaacaaagctatcttctatggctatatctatatatatccatatagatataaacatataaattcacagcaaaagatctagaaagatatatagtgttttagtccattttctgttgcttataacagaatacctgaaactgggtaatttgtaaagaaaaggaagttatttcttacagttatggagtctgagaagtccaaggtcaagagtgtgcatctggtgagggccttcttgctggtgggggacacctgcagagttcccaggcagtacaagccatcatatggagggggtgctgagctgctcccttgctagctaaggtctctctccctcttcttataaagccatcagtccccctcccaagataacccattaatccattaacccattaatccatgaatccatgaagagattaatccattcataagggctccaccctcatgatctaatcacctcttaaagggcccaccacacaatactgccacattggggattaaatttccaacacatgaaatttgggggacacattcaaaccatagttcatattaaacagataataatggttagttacctcggcggaggggcctaggatgcgagtcaaggtcaaagagcatttgtaccttatctgcaaagtttaaatattttgcaataattcgcgtgttatttgtgtaagtaaaaatttaaacataatttttcagagacaactgcccagaccagctccagggtttggccgtcagatcccctggtgcatgtttctgatcagatcaatttcttctcccggagacacccaatccgggtcgtatggattacctgtgggttaaccaggggtctccgggttaaccatccaactcagagtaaagtttctaaaaatgcgttttgctctaatacctattcggaaccaacctgggtctaaagactggagcaagtgtttattttccaaaacacggctttttaaaataattctatagggatcaccttgaacacacgttaagcaaaaaaaaaacctcagcgaaaacgcctcgcaatgtccagattaaatgcaaaagcaaaagcattaagtagctttctggcataaacatattgcagctgggtagcgtggccgagcggtctaaggcgctggattaaggctccagtctcttcgggggcgtgggttcgaatcccaccgctgccagggttgctgtctttttgtccccgctgcatacactcctggctcagttttgcgcgtgccatcagcgccccctgctgcagggcggggctcacggcctgcatgaatggcgcggcggagggggcggagccgcgtgcaccggggcggggcattgtgggtaagaggaaacgctggggccggcccgctcccccccacgtgtccgccggagtttctccaccagcaacatggccgccgcctgagaggagagccgggccgccgccgtctctgcagcccgcgggtaactgggccgttgccgccgtccgcgctcggcccccgcggagaggtgagtcccgtcttggcagtgcccgagctggggcttgagccggaccgcactcacgacgtgggcctgggctagattcccgagtaggccaaggaggcccgcgccgcgctgtgcctagcagctggaggcctctcgggactcgggcggggaggaggggcagccggctccaggccgaccccggactctgacttccttgacctgacacctgggagttggggaggccgcggccgacgctggcggcggtgactcagggtccagccgacctgccctatccgggcctgggaggcctcctacggaagaaacacctgtccgcgcgtcgggtgtagtggcggctcgcggcagggactgcgtggtgggcgtgagaaggggggcctgaccacccgcgagggagcagaaacccattggacagcgaggctcgggatcggcggcccgccccgatgggcagggagggcacctgcgcctgccggagcccccacttcgcagctgaaccggattagcctctgcccggcgaggccagggattcctcattcatttattcaggcaaccattcagtgtttaccgagccaactctgtgttccggatacagccctgaccattcggtccgaggaggtgtcagtaaacaaacaaggtcgttcctttgggttagctttagaattccttgggcttggaggcggaaagaagagatcttagcgatctccacagtttcctcatctgtgaaatagagataatagaaattcctacctcatagggttgtggtgacggctcagtagaaaccgggtgacgctcctgcttgcagcgtttgacttgtggcttagcgtcattacccgcttacgttggcagaaaacatgttgtcaagtaataacaaaccttcccagaggttacgtttattagcgtcctgtccttactccttccccgcaggggtctggaggtcggtacttagtttccctactttagggatgaaaatagggaggaataccaaacccagacaactcaggtgggtcacagatgccaagcagctgtggtgggatttgaacctgcacagttttgttctcgggtccaagctcttacccacttaaccatactgccgtttatcagaaaaccgtgcagtatagtggttaagaataagaataaggatctttgacatagcgagacccaagtttctgtcctcattccaccttggatgagttgcttatatctgaacctcagtctcgtcatttccaaattgaagatgataaatctctattgatagggctaatgagaagattaaatataaagtattctttgtactatattgagtgtcaacttcgtgccaggcactgttctaggtattgagagaaccagcactggattttttttttaaagtaatgctccccataacagctttgatgaagtaaagtatgattgtctgcatttcatagttgaggaaactgaagcactgagaagccttcatggagcttacgttctattgcagaagacaaacaacacctgagcaaatagaccaggtagttccagattaagatgagacccaccaaggaaagaaaacagagatgtggtagggcctgggaggaggctgggggaggcttttaaaatagggtggtcagggaacctatcctctcctgcaggcggtgatgatatttaataaaaaggagcaaccttggaaatccctgtgggagaatagatgatgtgcaaaggacctggggtggactggggcttgccttgttggaggcccagcaagtggctaccagcctggatggtgaggggaagacagagacaagattatgtagggccttaggtggctcatggaaaggagtttgggttttattttatgtgacagtggcagttgacaggtcttaggcagggaaataatatgatttactttttttttttttttttttttgagatggagtcttgttccgttgcccagactagagtgcagtggcaagatctcggctcactgcaacctctgccttctgggttcaagtgattcttctgcctcagcctcccgagtagctgggattacaggcgtgcatcaccacgcctggctaatttttgtattttaagtagagacggggtttcaccttattggccaggcttttctggaactcctgacctcaggtgatccgcctgcctcggcctcccaaagtgctgggattacaggtgtgagccaccgtgcctggctttgttttccccccagtagagatcgagtctcacactgtgacccaggatggagcgcagtggtgtgatcatagctcactgcagcctcaaactcctgggttcaaccaatcctgctgcctcagcttcccaagtagttgggactgcaggccatgccaggctaaaatttttttttaaagagagaccggggggcggggggcgcctcactatgttgctcaggctggtctcgaactcctggtctcaagcagtccttccacctaagcctcccaaagtgttgggattaccggcatgagccaccatgccagcctgatttacttctttccaaagactcactgttgctgggagacttggaggtaggtataaggagccgtagggagacttggatgagtgcttttcacattgcaggttaaaatttattagtgggaagtaaaatcaatttaagggaattgaagctagcattttttgttttgaatgaagtagaaaacatcacggcctgacatatagtagggacagttatagttacgtgaaaccttgtttcagttatgcaactgtatgtatgttctgggttatttatatgagatggatttcttactgtggtggatcttaggctgaaaactttgaaagccactgagttggatcacctcggcctggaggatgaagggaggtgacactctttgtatcaacccagatgtactatccagaggaaggagctccagctctctagctgacagggcacctcagcctccctgatccctggcagggcagaggccaacagggcatagcaatagccaagaaagaacaattgcgtcttgggaacctcccaggccccagcctctcagttgtccactgcccagctgcagagaaggcaggagcttgacatatctgtggcacttggcagccggtgcagatggggtgaggccttgggctctccgctctacactgccctctgtctgcacagcagacagtcgagatgcactgaaactgtccagatgcgactcctgattttcattccatcctccatctctgggactgttacgatagctgtttccctgaagtttctctttctacccgctccatgtcttcctctgcccgaaatccttctgtagcttcctattaaatagcattcccatggttcatttatttagacaacaaacatgtattgagtgcctgctgtgtactaggcacttggggtaccacaagggacaaaatagaccaaaatctctgccttcacatagcttacagcttagtggcaatagagatgggcacagatgcagagctgtaaactgtcacatggtgatagacacctgctatggagaaaaccagagcagagaagggaattgaggggtgggggaggcagtttgcaatgtgatttggagagggaaggtcttagccacaaggtgacatttgagcaaaaaccggaaagaggtgaaggggggaccatgaggttatcgggggggtagagcagctacaaagccccagaagtgggtttggagcagagaggagggtaggaggcttgtgggagatgaggtctggcaggtcaaggggcaggagattgtttagggtttacatgggatgataaagactttggcttttgtctaggtgtggtggctcatgcctgtaatcccagcactttgggaggccaacacaggtgaatcacttgaggccaggagttcgagaccagcctggccaatatggcaaagccccgtctctactgaaaatacaaaaattagctgagcggatggtgcatgccaattattgcagctacttgggaggctgaggcaggagaatcacttgaacctaagaagcagaggttgcagtgagtcaaaatcacggcagagcacttcaacctgggtgacagagcaagacatgtcttaaaaataaataaatattagatagttcaaatgttaagtagatcagacaaaaatcatgctggtctcagccgggcgcagtggctcacgcctgtaatcccagcactttgggaaaccaaggcgggcagatcacctgaggtcaggaattcaagactaacctggccaacatggcaagtccctgtctctactaaaaatagaaaaattagccgggcctggtggtgcatgcctgtaatcccagctacttgggaggctaaggcaagaatcgcttgaacccgggaggcagaggttgcagtgagccgatcgtaccaccgcactccagcctgggtgacagagcaagactccgtctcaagaaaaaaaaaaaaaaaaattcatgctagtctcacccaagagcagaggtttgggaactgctgaggcctgggggtgcctgagtaccatcctacctatgaccacccctcttctctttgggtatgtgaaggggcagaccagctgaaatactcaacctgccccgtggagacctacagccttccctcttcctggaatttctcctcccctctgttgtcatgacttgcccaaagctctctcttcttccaggcgcacctaacgtgcctcctccccagcagaaaggcctttcccgcctctcaactcccctacctgtacctgtcacctgaggtcagacagcctggatttgaagtccagttcatcatcctgcttgctatgtgactttgggtcaaaatgcacacagtatctctgagttccagtctgttcattataaaacagtgacaatcaccacacctcatagggtcattgtgttgaatacaggacagaagagtgtgtgaagaggtcatttttagaccaaaaacacagaagagtcatctcactcaggattcgagttaaagtcagcttgaaaatcaaatatcagagagctttggactgtctgtcttcctgttcaacttctggctcctctttaaagcgtccccagggccctcagttctccagtgttttaatcatggctgggaccagccaacctctatccttctgtctggcagtgaattctctgtgagcagagaagaaaccattaaagccagtcatttgcctttccccgcaggtgcagcccacacttgttggcttggtctacccgcttgcacccgctgcttgagtgtttctttttttctttatttcttctggctgatggggtatagggttggtcatccattgttgacttcaatgtagatgtagaaagaaggtcagttggttggttgtgggctccccctcccagtgcagggcctgttgcagaataggcacaaggaaatgttggttgaacgactgatggtcccagtctctcgccctcctttgcagatcgagctgaaggactgcgcggctggctctcctctagtatggccaatgaagaggatgacccagttgtacaggaggtaactgctgctctctgtcccctgccgccggggctacaggcagtggaattgggtcctttccatgtgtcctcaggccagtctgggacctgttgatgttctgggacccctaacccttgctgttccctctgcctggtcccctctgctgtcccccagacccctgcgtggctgacctctcccttccttcaggtctctgatctggcatcacctcatcagggaggccttccctgactgcccttccacacccagctcccctcctgcaccctcccgtgcctctctctgcccttaccttggcggtaactcatacttggcctagcccccgtcatcccctagatatcagttgattgctttctttcccgtccactgctgtgccgcaaagccgagtatagtgcctggcacccaggtacccggcgactatttggtgaatgaatgaatgaataaatgggctcagcagtccctccttcccaggcttacgcagatgtagtcattcagcagctgttcactggaccactgtgtgctgggggctgtgacacatcagtgagcagggcagggtccccttccctgggaagctaatgggctgtgggcaagactgatgaggcaggagtctccgggtacaggcagtgggaggcagatttcccttttttttttttttttttggagacagagtcttgctctgttgcccaggctggagttcagtggtgccatctcggctcactgcaaccttcacctcccaggttcaagcgattctcctgcctcagcctcctgagtagctgggatcacaggtgcccatcaccacgcccgactaattttttttttttttttttttttgaggcggagtctcactctgtctcccaggctggagtgcagtagtgttatcttggctcaccgcagtctctgcctctgggttcaaacgattcttgtgcctcagcctcctgagtagctgggattacgggcgcccgccactacacctggctaatttttgtatttttagtagagatgggatttcaccatgatagccaggctggtctcgatctcctgacctcaagtgatcacccaccttgggcctcccaaagtgcagagattacaggcatgagccaccatggccggcacaggtttcccttcttagagaaagctgttgatagtcaaactcacctttcagaatccttttaacccaggacttagacctttggaaggcaaaaggcaaaaagtaactgcatctgccttcagcctccttatatgcggagcctgacctccagtgggaagggcaggggcaaggagaaggtcctcggagatgaatagaggtggtttttccttgcttgggggatgttgctaagttattagatgtgagttatttagatgcatttaagctgcatctacactgcagtagcaggagttacaacaggggggttggtgatgggatagaagagtccaagggactccgaggacagaggcagtgccctctgcagccagggggcctggaatgcttcctgcccaagttgtgcctcagccaagtccttggaggagcgagcagtcaaggctcaggggaggcatgtgtgaagggctctgtaggtatagggaaaagcatgtgcaaaggcccaggggtaggagagcatgtggtttataggaggagttaggaagcaggaaggtaaactgctgcgtggcggggtgggggtggttagtgttgggaagaaaggaagtggagccatcagtcacaaagggccttgcagaccccttaagaaggggtgacaggctggtccaggaggggcaggtggagggcccagccaggaggcacaggcctaggtgagccctcgcctgcctgcctctcagaagagcatttgcccaggctgtaggacgtttcccgatcagtgcagccccagggaagatgtgtgcttactgggggattgtgaacttgggtgggggtaccaggtgaactcttgccctggttcccctgggagctttcaggagggattcctgaatatacccagtgtgcagccttggatccgcttgcttttagcatgagctgagctatttcctccttccccaaactgcttccctgagccactgcccttaactgaagctggaagcgctggcatagcccggggaggtcagcactgtgtccagtctcccggttaagtcgtcttcccttcttcccagatcgatgtgtacttggccaagagtctggcggaaaagctgtatctatttcaggtaattatgggacttgaaggtaaagaggggagaagcaggtgtgggtgggtggtgtggactcaggaacacgggcaggaaacgatgggaaacctcagctagggttctcggtgtggagagtgtcatggggtctctttgctttcgtgggtgggttaatattggtctcatttcaaagatgggaaaactgaaggaacacaggagaggcagaagtgtgcagcagttaaagctggggctctggggtcagaccggattgagatccaactccatcacaccatagctgcgagaccgtgggcaagtttcttaatccttctgtgcctcactttcctcacttgcaaagtggtgatggtgataatgcctgcctcataggtccccaggaggacaggctgagtccacagtgaagtgtttaggatgccgcctggcagagagttggtgccagtgatgatggccgctgttgtcatggaggctccaaggggcagctccatggcagcgtctgtgagccctcagtcctgccagctgcgagggccccgggttgctacctctgccccctccccttgctgctgggccagcagcttgtcattgtggccaacatgtattgagcattgaccgtatgcagactgttgaaagcatttacctcagttacctctttaaccccacaataaccctatggtggtgattattacattttataaccgatatattgagatagaatttacacaccacacagtttccccatttcagtgtgtaatgcaatggattttagtctactcatggggctgtgcaaccagcgccacagtctgttttgggacagttttgtccccctttaaaggaaccccttgcctattagcgatcagtctgtgccccccattcccacctccaaccccaggcaaccattccccttattttctgtttatggttttgcctattccggacttttcacatagctggaatcatgcagtatgtggcctgctgtgattggctgctctcactttgcatgatgttttcagggctcatccacatggtagctatagcctgcatcaatatttgagcttttcttttttttgtttgtttgttttgagacacagtcttgctctgttgcccaggctggagtgcagtggcttgattgcggctcaccacaacctctgcctcccaggctcaagtgattctgcctcagcatcctgagtagttgggactacaggcacgcgccacaagcccggctaatttttgtatttttagtagagatggggtttcactatgttggccagcctggtctcgaactcctgaccttgtgatctgcctgcctcggcctcccatagtgctgggattacaggtgtgagccaccgctcccagccaatatttgatcttttactgatgaataatgttccattgtatgggagaccacagtttgtttatccattcatcagctgatgggtatttgggttatttctactttttggctattataaataatgccactgtggacattcacatagaagtttttatgatgaacgtgaattctcatttcttctaggtatatgcctggtagcagaattgctgggtctgcgtttagctttttgaggcactgctgggctgctctgccccatgttgccttcccacagttagagtcagtgttcatatcccatgatgcacatgagaacgtgaggcacagggaggccttcacgggcacggaggcctggggcatgccacagcagcaatgttgtaagcctgtgctgggagggcctggcctccactccctggggttcacccttatgggccgtgggaatggggcctgtcctgtgtgcctgctcaccctgtttccttgactggctgcaaagtgatggtggaggtgccagtgacccccgtgtgtccagagttccaaaccctgagccaccatcggctctgtttgcctcctccgtgctcacagcggccttgggaggtgaggatgcttagcctcagggaggcgaggtgcctgcctgagtccacagttagcaaggggaaggatgaggactggaagccaggcctgtgatttcagaacctgcgcccttcagccttcccacccccagtcaggtgatctcagaactgcccccagccccagcccaggaagcagggaggagtcacggctttgctgtgtgagtgagcttttaggaaatgaccgtctccttgcgctagaatgtagctgatctgaaagggcctattttccgcactgccatacctccaccaggctcattctacaggctgtcatgagaccaggcagagcttttgaggaggggtccagactttgactccttcacctgagagagagagggacagtgtactgtgaggacagatgtggacaggagcccctgcgtgttgagcgcattgctgtgtgagccattcacataaagataagagcgggccatggctgcctggctcccttttccagcatcttgtgaggaagctcacacaaccagataaggagagcgaatggattcacgaattcccacctgcccgtcgtctggcctcagcagtgagcagcacgtgccggtgttgctttcactctttgcttcctcatggactccttttggtcgtccttctctccccggatggcctgtccactggtagttaggccctggacccccatcctcacctcccatggccgtgctctgtgggttcctggagcagcagcgtgccggtttgggttcctgtgtgtagacacgtccctcggaagtcagagacatcctgcagtggccctttggaaggaggccgtggggagctgatgagaatagggctgcgggtggagactggcaggggtgcctcatggtagggctgggcagcttgtacccttgtggtagggtaaggccagtctctgcttggggtgggcttggagatagctgttgattcttggccagggcccagctctgggcatggctgggcagagtggacttaatggctcccttcccctccccagtaccctgtgcgtccagcctcgatgacctacgatgacattccgcacctctcagccaagatcaagcccaagcagcagaaggtggggctgccccctgagggcagttggggccgaaagagagggtgatgagggtgggagctggtggaggcgagaagctcagagaaggagtcattggagaagtaggagaaccagcaactcccaggcccttgaaagctgaagaaggaaagtgtccagaaagacagggatgggcagctccagagaggccagggacgcatgaggctgatgaatgagagaatggggccagatgtgagcttaggttcccaggataagacgagggcgggcgggtgaacatggagtaggtttgatgggaagagaatctagcgcctatccatggagggtctgcagctctagcccctccagccacatggaagtgccatcccagtattgccagttctgctggcttttcaagagaagtgggaaataaggatttttatgagaaatctcttgatttttaaatgttggcacctaatttaggtctttgggagtgaagtagaggacaaacaagattacaggactctccacttccttctgacatttttgttggaatttgggtttgtgacccttggtgtggactgaagtccaggggcccttggggacatgtgtcagtctcgcttccgggcagggtcctggttaggaggtggccatggtggggttggggtgtcccttgaggagccatgccttggggtcctcatagctggtgggggtgcttggtgcctccaggtagagcttgagatggccatcgacaccctgaaccccaactattgccgcagcaaaggggagcagattgcgctgaacgtggacggggcctgcgccgacgagaccagcacgtattcctcgtgagtttccggccccaagcctgtccggtttccctgcgttcacacaggagcctccaaaagaccttaaagacattgaccccctttgccccgtcactgggctccccaccagtgtcccagcctttggagggctgggcctgtctcagactctgccctcctgaactagctggtcccagagctcctacccactcctcgtctcttggtctacaaacaaggccatgggttttctcatccccaggctgccctcctgagacccgcgtaggctgccctgcggccttggtccctggctgtggcacttcagaaagtgtctagggggtggggtgcgctgtggccacaggccctggctcggagctgccttcccctgtgacgttgcttctccctgtgctccaggaagctgatggacaagcagaccttctgctcttcccagaccaccagtaacacatcccgttatgccgctgcactctacaggcaaggtacccggggctgggtgtcccgcggtggggacatggcattggggggggctgggcagggagagtacctccccagcctggtgtccatctcccacctgccctgaaagctagacacctgtgggggccgggcaggtgtggaaataacagaaatgacacattgtcaggggactggaagtggccacctttgtggactgctggctggacactgcctgaccagatggggtggggctccaagttcatttgtcctcccgggacacagatacatacaagtagctaacataagtttagggacagaattttgtctttaaatatgaagcttatgacagagcaattccattcctaggcagcatctatccaaaagaaatgaaaacatgtgtccacacaaaaccatacacagttgttcacagtagcatcttcatgatagccaaaaagtggaaacaacccagatgcccatccgctggattcatggagaaacagaatgtggtccattcacgcaatgggatgttatttgaccatggaaaagaatgaagcagtgatgctaccacgcagatgagccttgagaacattgtgctaagtgaaagaagccacatgcttcttcactcgcagctacgcgctgtgtgattacgtctcagtcagcgaccgaccacatactcaacggtggtcccataacattataatggagctgaagaattggcttacctagtgatgtcttaatgagcctgaccctgtgtaagcctaggctaactcgtatgtttgtgtcttaggtttttgcttgttcgtttgttttgttttgttttgagacagagtctcgctctgttgcctaggctggagtgcagtggcacagtctcggctcactgcaacctctgcctcctgggttcaagcgattctcctgcctcagcctcccgagtagctgggattacagacatgcaccaccacacctggctaatttttgtatctttagtagagatgggattctgccacgttggccaggctgatatcaaactcctgacctcaggtgacctgcccacctcggcctcccaaagtgctgggattacaggtgtgagccaccatgcccggcctgtgtcttagtttttagtagaaagtttaaaaagtttaaaaaaaaaaaaaaaaaggtaaaaagcatatagccgggtgtgttgcctcctacctgtaatcccagtgctttgggaggccgaggcaggcccaggagttccagaccagcctgggcaacatagtgaaatcccttccctacaaaaaatacaaacattagctgggcatggtggcacatcccttagtcccagctactgaggaagctgaggtgggaggattgcttgagcctgggaggcggaggttgcagtaagctgagattccgccattgcactccagcctgggcaatagagcaagactctgtcttgaaaaaaagcatatacaataaagatatatttttcataaatttatttattgatttattttttggagagggagtctcactctgttgcccaagttggagtgcagtggctcaatcttggctcactgaaacctctgccttccggtttcaagcagttctcctgtctcagactcccgagtagctgggactacaggtgcacacaccaccatgcccagctaatttttgtatttttagtagagacagggtttttgccatgttggccaggctggtctcgaactcctgacctcaggtgatccaccagccttggcctcccagagtgctgggattataggcatgagccactgtgcccagccttttttttttttttttttttttaataaatttagtgtagcctaagtgtgcagtctgtatgaagtctacagtagcgtgtagtaatgtcataggccttcacattcactcaccactcactcatccagagcagcttgtcctataagctggttttagtcttttatactatacttttactgtaccttttttatgtttagggttttttgggtgtgtttttttgttgttgtttgttttggggttttttttttggagaccgggtctcactctgtcacccaggctggagtacagtggtgatcatagctcactgcagcctctatctcctgagctcaagcaattgccttccctcagtctcctgagtagctaggactacaggccatgccaccacatctggctaattttttaaaaaattttttgttgaggtggggtcttgctatgttgcccaggctggtctcgaactcctgggctcaagcgatcctcttgtctctgcctcccagagttctgggattacagatatgagccactgcacccagcctaggtatatttagatacacaaataccattctgttacaactgcctacagtattcaggggagtaacatgctgtacagtgtgtagcctgggagcaataggccataccatagagccgaggcgtgtagtaggctctgctatctgggtttctgtgagtgcactctgcgatgtttgcacaacgatgaaatcacctaaggatgaatttctcagaacgtatccctattgttaagtgatgtgtggctgtatgtgaaatgtccagaataggcaaatgtacagaggcagaaagtagattagtggctaccagggactagtgggagagtggagtggggactgcctggttctttttgtggtgatgagaatgttctaaaattggttgtgctggctgcacagctttgtgaatacgttaaaatacattgaattatggccgggagtggtggctcatgcctgtaatcccagcacttttggaggccgaagtgggcagatcacctgaggtcaggagttcgagaccagcctggccaacatgataaaatctcatctcttccaaaaagtagaaaaaattagccaggcgtggtggtgagtgcctgtaatcccagttatgcaggaggctgaggcaggagaatcgcttgaactcaggaggcggaggttgcagtaagccgagatcgcaccactgaatatcctgggcaacagagtgagactccatctcaaaacaaaaatacattgattagtatgccttaaatgagtggactatatggtacgtgagtcttgtcccaaagctggtaaaaagtacaaggcgcggccgggcgcagtggctcatacctgtaatcccaggactttgggaggccaagacgggcagatcacaaggtcaggagatcaagactatcctggccaacatggtgaaacaccatctctactgaaatacaaaaaaatttagctgggcttggtggcacacacctgtagtcccagctacttgggaggctgaggcaggggaatcacttgaaccggggaggtggaggttgcactgagccgagatcatggcactgcactctgcactctggcctgggtgacagagcgacactccatctcaaaaaaaaaaaaaaaaaaaaaaaacagtaaagtgcttaagtatttagtctcaaaagcaatgaacgaaactaatctgaacacttaggaaacaaaatgggataggatcaaaagtagtgtcatataactcgcgcgttctgtttagaacccatgtctcaagcatgtaattcttgaaagccacatcccttgcagcgggagggaaagtcatgatctttatcagaggccatgtggacactccacccagttctagcagggcctcttctccagccacagtggcactagtggacttcctagtggaacgggtgggattttggcgggaaaagatggaggataagaaggagaggaaatccaggtgtgtggggcgggacagtaaggctgagctggccgaggcctggagggtaaacagcagggcgaatttgatgaggattagctgcctagtgttgcaaagcgagcagctggggagaggggcgtggaaccagactgggaggtgggactgaaggaagtggcttcgaacagaagagtccaggttcctgtcctagtctgggctgtgtgcttgctgtgtccagcaggccaggtggaggtggggatggtccctggcctggtggtcccaagactctaggattgggggctgcagcgggaatgggaggcggtttgatggtgggcctaggccttcacgggacttggtgactctcttgagccaaactgggtgggtttctagagttgagtccaagcccttcttcctccgccaggtgagctccacctgacacctttacatggcatcctgcagctgcggcccagcttctcctacctggataaggctgacgccaagcaccgggagagggaggcggccaacgagggtgagcccgggatccccagccctgctgcctgcctgccttcatcctggtgggatggcttggtcctgggaagagggatgggatgataggatgtttagcaggatccctggcctctacctactagatgccagaagcacccaccccacagtcgtgacaatcaaaaaggtcacattgcccagtatccccagggtaaaggggcaaaactgtccccgattgagaaccactggcttaggcagctccctctgcgaggagaactcccagcaccccggcctgaggcttccctggcgggtggggttgagagaagggaggtggaggctccccaggactgcagtcagtggcttgtctctcttgcagcaggggactcttcacaggatgaggcggaagacgatgttaagcagatcacggtgagccctggcccctggaggaggagggtgctgcctgggcggcagcaggaccagagaccaaggggtagcgggtcttcacagaatgcaggtggagcagacagggcccatgcttttgagccttcttgctgggctacctggagggaacaacctgagttgttccagctatacacaagatggaagccctggctggatccaggagatgtgtgcctggggcttggctagagtcacctgggagcaggaagctggggccaggagccctgaggacccgcagaccagctctgccatgaacctgtatcttaacagagccaaagtcaattaactgtgattctatcctctttatggggcacggatgaatagttttcgttttaatagttattcctgaattttaaagatttttcaaagaatcttaaccttccatttatggtttgtaaagttttccctatttaagcatatttagattaaaatgagtagtaccaaaagaaaaatgctacacgtagaatgatgatacacaagtatggctagagagtggtgagtgtttggaagcccttgaggaccggggaacacgggcgtaatggacatggaggtggcgcagggagctcatcctgttctctccgtagcttattaggaccttagaaactcccttccgctctggggaacttagaaaaggcatcctgggcctgtctgctttaaggactctgctggctctggcgcctgggactctaatccccctcaagcctctgggctgggcaggcacgagcaagtataagccgttccctggcgtgtgcaggcagctctgggagggacacggttggaacggaatttaaacgacctgtgctaggaaaggaagggagagtggaaaacccctatacggagttctctggtcttctggcaggggctgagacggcagtccagcaagggtcacaggcctgacggtatgacctcttccccttcccaccgcaggtgcggttctcccggccggagtcagagcaggcccgccagcgccgtgtgcagtcctatgagttcctgcagaagaagcacgcagaggagccctgggtccacctgcattactatggcctgagggtgagcggggcttcgtggggtcctgggggaaacacctcggtgcccggaagggtcatggtgtggcctccgtgtctcaccttgaacttaagtcaaattcatgagtcatagccacagatagaggatcgagtcctgtgggcagtttacacttcactccagccgagccacttagcgtgggccccaggagagcaagaggaaaagatgcgagtccttggttccctgggtggggtttggcccctgggcatgggcatcttgctgggcttgcagtggggctagtgcctggtaacatattttcgctgcagcccaggccctaaacgcaggccagatgcattctccggttctgtcctagagggtcggtcatgtgttgccaccccagagttcccagcaccacctgcccaggggattttcttactgtgcttggttttcatctggtacgctgactttatttacttttatttttatttatttattatttatttatttattgagacagtctcattctgtcacccaggctggagtgcagtggctcgatctcagctcactgcaacctccgcctcccgggttcaagtgattcttctgcctcaacctcccaggtagctgggactacaggcacctgctaatttttttgtttttgtttttttagtagagatggggttttgccatgttggccaggctggtctcgaactcctgatttccaagtgatctgcccacctcaggctccctaagtgctgggattacaggcgtgagccacgaccacctggccctggtgcattgattttagaacctaacccttgaaactgtgtactgagtgagggatgcttccaaagacaccatgggccagggctcccaatattttctggggtggggaacaactcctgatttctctggaaccttcttggaagagatttgtgttaacagacccttagactcggggtcaaacttctagacactgctgtttcctgctgtgtgaccttgggcatgttagctaacctctctgagcctcagttttcttaattataaaatgagagtagtaataatagtacctaccttgccaagttattttgagggtgagatgggttagtatatttacagtcagtggaacagagtccaccacatcctagatgcccagtgaatgttagccatcattttgtcattgctggtggtgtacctgtgttacagacaaggcatcgaggcttgggggctggggctgggcaggtcataaggccaggaagatgagtggctgaggccacgtcagaggccttgggtgccgtgctcaggaggttggatgtggtcctgtggctggccatggagtggaagacgggaggccttgggggagggggcccaggccagggccatcagctgaggctcctctcacaccctgccctcctccaacaggacagtcgctctgagcatgagcgtcagtacctgctgtgccccggctcaagcggggtggagaacacggagctcgtcaagtcacccaggtgggatgggctgggccagcatgcaaactggatgcctgcccagggtccccaggggtccttggtgtggatcctcccagaggactgtggcccctcctgtagcatgagggtggagcccattgtcccctggagaaggccaggagggtgggcctggaaagagatggtccacttttctgcaggggctcagggctgctgggggagggcgggggtgggctgtctgcaccctctccccagaccctcacttgggtggctggtgaggagggtccagcctggatcagccctgagcctctgcccctgccatgtccctgcagtgagtacctgatgatgctgatgccacccagccaggaggaggagaagtgagtagaggcggcaggacaccctctccctttccgggctggctgcctctaacccgtcccctctgcttttcccagagacaagcctgtggcccccagcaacgtcctgtcgatggcccagctgcgcacgctgcccctggccgatcagatcaagatcctgatgaagaatggtgggtgcctaccccctgcccacccgggggccccagtcccagtggctcctgaggaatggactctgtgggacagtgaggaccaggggacaaggccagaggcccctgctgcccacagcctgcccagctttgcagctgcatccttgtctggaaagataacgcaggacggcagtgcggccagctcccgcaggcagcccgggttcccgtgaatgtaggacagtagtgtgtctggcccccacaggcgggctcgggttcctgtgccatgctcaccacttgtctgccatgctcttgggcaggtcatgaacctttctgaggctttgtttgtttttctgtgaaaagagactaatgatagttcctgggggccaatgtgaggaatcagagagaggaggcttctaaagtacagggccttgcaggcgaacacggactaggggctttttgttgttgttgttgttgttgttgttgtttttttttttaaggtttttttaaaggttttaaaggttttttttaaaggttttgctgtgtaactcctgggcccaagtgatcctcctgcctcagccttccgagtggctgggcctacaagcagacgccattcactgcaccggctcaactagggtcattttcatgacaatgtcttcactggcattgcttctgggtactcttgccagacctggcaccataaggactggtctccttttctcagaggactctgagtgccagaacctttagggtacccgtggctggtgaacaacagacctgatccttgagttcagaatggagccgcagaacctgggctcgtcctttgagatgccaccatgagctcttaggagtctaaggagagaggggagctccatgatatgctcgggattttaggcttccttcctgcagaggacttcgaactttttttttttttgagacagtcttgctctgtcacccaggctggagtgcagtggcacaatctcggctcactgcaacctccgcctcccgggttcaagcaattctcatgcctcagcctctggagtagctgggactacaggtgcccgccatcacgcccagctaatttttgtatttttagtagagatggggtttcgccttgttggccaggctagtctcaaattcctggcctcaagtgatctgcctccctcggcctcccaaagtgctgtgattacaggtgtgagccaaagcgcccagccaaattttggactttccctgggccctgcccagggctcacttgggcgggagcagagcacagtgattgagggtaccaagtggagccaagtggcttgggttcacttcctggctctgctacttcctagccaagagatcatgggtgagctttgaagcctttccaggtctgagtagtaatagacccttcctcctgaggcacccctcaagtcttccttaaggggcacttcatataatcctcagatttcatgaggtgcccagtgcctggcatgtagtgagcagcctgagagtgtcagctgttggctatgatgggtgtcattactgttagttatcacattctggggttattacatgaacttgaagctatgcggactctcggtggaggggagggaagggcccggcccctcttccttgtctgatgtctcctgcgtcctcctcagtgaaggtcatgccttttgccaacttgatgagcctcctgggcccctccatcgattccgtggctgttctgcggggcatccagaaggtggcgatgttggtccaagggaactgggtggtgaagaggtaagttgctttttttattttttatttttatttatttttttccttgaggcagagcttcactcttgttgcccaggctggtgtgtagtggcgcaatctcggctcactgtaacttctccctcccaggtccaagcaactctcctgcctcagcctcctgagtagctgggattataggtgcccgccaccatgcccagctaatctttgtgtttttagtagacacgggtttcaccatgttggccaggctggtctcgaatcctgacctcaagtgatccacccacctcgacctcccaatgtgttaggattataggcgtgagccaccgggcccggcctacgctgtattctcttaatgggagcatttggtccttttaaatttaatgcagttactagtgctttgggtttaaatctacagtgctttctatttgtcctgcctacattgcatttaaactgttttttgtttttttgtttttttttttgagacagagtctcgctctgtcccacaggctggagtgcagtggtgcgatctcggctcactgcaagctctgcctgccgggttcacgccattctcctgcctcagcctcccgagtagctgggactacaaggcacccgccaccacgcccagctaattttttgtatttttagtagagatggggtttcactgtgttagccaagatggtctccatctcctgacctcgtgatctgcccgcctcggcttcccaaagtgctgggattacaggtgtgagccactgtgcctggccgcatttaaacattttttaaattgacacataatgtacatatttatgggggcagtgtgaaatctaaatacatgtatacaatgtaatgatcaaatcagggcaattaacatatctatcccctcaaacatttctcatttttgtgttgggcacattcaaacttcacttttctagctatttaaaattatacaataaattgttcttaattatagtcaccctgtagtaccctttgtcctgcctacattggatttttatatcattcttaccatctgctggattcatttctgtttctattttttcctgctaacttggaagttacactgtttgggctcatatattgattaccctacagttttcagcttacattcatgacttaacacattttaatgttaattgctgctttttaccccattccaatctattcagagatcttagaatattttatatctatcctcatacttacacactgctagattggtatatatatatttttttacctttttaatttgccaatcttctctagtgttccaattttagtatatgtactgccgaagagagcacaggattggtgtatttttattttttttttgagatagtctctctctcttgcccaggctggggtgcagtggcacagtctcagctcactgcaacctctgtctcccgggtttaagcgattctcctgcctcagcctcccaagtaactgggattataggcgcttgccaccacgcccggctaatttttgtatttttagaagaggcagggttttgctgtgttggccagctggtcttgaactcctgacctcaggtgatgcacccatctcggcctcccaaagtgctgggattacaggcgtgagctaccgtgcccggcctggtgtattttaattctctgtatgttttcagccccataagacattactgtatccagtcaatcaatattctttactcgcatgtttataatttagtcatcatttctttctgcatctctaagtttctatctgggatcatttcgttctgcctaaagaatgctatagtatttcctttaatgtgggtctgttggtgatgcatttccttggtttttgtgtgtctggaaatgtctatttcacctttgttctagaattctagattggtggttattttcctttccacgcgttgatatgattttgttgtgttccgacttcattgtttctgttggcagttttgttcttattcctttgaaggcagcctgcctttgttttcctctggctgcttttaggagtttctctgtttttggttttctacgggttcgtttagatgtgtctttaagtgtgaattttttacatactctgctggggatcacaggtcttgagcgtggggcttgatgcctttcagtggtttctcttcggcgaatcctcccctagaccatgtgctgcctccacgagaccatcagtttcaagggattagggatgtctgttttgactcctgctttatgttcccagtacccggaataatgcctggatattaccagtgcagacccttggtaaataatgtggctacgttttacttgaattatattgattctgaatgatgtagcattaattgcattaataactcactttttaagtaatgtagtttaaggtgagcaatgtgacaaaatgtgaaatgttgaacattttaagaaaatacaatgccttgaaagctcctcatagttgtagagtatattcgtgttactgccacctggtggcgcccttgcactgctccacaggtgcccagcgcagtttgtcagcaccttgcggctgttgtcctttgttacacgttttcatcatggaaggcttttgcaatggcgcatcgcgtattacataggaccacgtgtgtatatttacaccataagtgaatgaaagccaagaggggtcctcccgtcacacacctgaggacactggcccagagaggcatgggacttgccaaaagtcttgcagcaaggcagccgcagagccctgttaaaacctaagcctcatggctcagccctgggctctgcacccagcactgcatgtgtcccctggaggtgctgccccttttagtttcgccctgtcctggggactggaaggtagggacttggggactgtgggcatttcacctgccccggcacttctgtaagccctactctgctgctgcccatgctgccatgtcaggggcccctgggtgagggtcctgtgtgtgcctgtgaggagacaatgcaaaatccatgcctccattcagtcactatggctagactgctcgttctgtgccatggaccgggctctcattcagacactgcccctggggatggcggctgttacatttgagctccctgaatgcagagatcatggcatggaccaggtttgtttggtcagcacacacttaataggtaccttcgctgtggtggcagcgatgagccacatcggcagagtccgtgtccccacagagcgtggccttgcaggatgagtgacagttggttgccaggtggacctgagcagggggaggaggagggcttggcagcagagggagggacagtcagagcacaggtgccgcagcaggggctgagccggggttgcagggcctgtggctggagctgggtcagggctacactctggagattctcgtgccctgctgtccaaggccccggcctttcctctgaagttccctgaaccttgagtgctgagcctgttctctccgagggctaacatgcctcccctgcctctgacctcggttcatgcccacctgcccctttcagcaggtggccaagggcttgcagatggcttcatccctggttctcttggtgtcacgtgcagggaccagttgtcttccagagtcctgggctccttgaggtcccgggctgttcctcaccttgtctgtctctgagcccgtgacctctccctgaatgtgcaggggtcttaggatgaggctggtgtgcatggcgggttgaggggtaataagaggaagaactggggggatgtgtggggtagaggggtgcttctttcccatgtctgtgttcacagatgtggctcctaaggggaggtcttggggctcaggcctgtacccagcccacggtggaaagaagcatggactggggcttggccgggaggggtagcggtagagggggctcagggcagggactgacctgccatcctcacctgcattggcagtgacatcctataccccaaggactcgtccagccctcacagcggcgtgcctgctgaggtgctctgcaggggccgagacttcgttgtaagtaccttgggttctctggactcacggtgggggcgtgggaagaggggggcagcggtgcagggcttctgaagaccggggcccggcagaggctccaggtggaggcgggtgtgtgaggaggccctggcctctgcctttctcctccttcctctcagaagcctggagtctcgggctggaaagaaccttccagttcctctagcgcagtcggggggtgggtcaagaagcacgtttcattcggcctgagtggtggtttagaaatattgccttggttgtcagattttataaattgaaattttgatgtaaaaaaaatcttgatgctagacagatgtctagctgtcaagggtaattggactccctgacacccctggggccacttccccacaaggcgctggcggtctccagttcaccacagtcccaggtgcctttgcctcccttgtgcctgtccctggagtttgggactcctgagctggtgtctcccttcttcccatcaccccacccatggcctccctcccaaggcctggaactccatgcagctgggagccacagtcttcctaggcttggtgctggctgaaacgtgctgcccaggagctgtcccacaccccttggcacgctggtgtgccgtcccagtcacaaggcagcccttaagctgaaggaagcatctgcctcttctcttcctgaaggagcctccccaactcctctgggcagtcggtgtccaggtgcccgagcagcatctttgctcctaggggtcagcatgtaacaatcaccactcccaggcttgcctccccagatacagtgccgtttgcccccagctgcccctgcccgccccgctccagtgtgtagacactgtcagaactggcggcttggtgggggtgtggtccagtctatgttagcgtaggtgatagtcatccattccctgtgtctctcagccagccacccttctctctcccagtcaccccacaaatctaatcagagtgcaggggagctgttgaggcagagtgggggctgcagggggctgagagcttctggaaggatgggcggcctccaaccagccattagcagccaccactgtgaagtgccgcctatgcagacagcgtgtgtctgtgggagcccctcccagcccgagtcctcatcgtatcctcggagctgggcagggcatccccagggagcgctgtggtctaggtggggtgggatggtcccatggtccccttggaagagatgggcctggagctcctttatggaggagaaaaggagggaggtgcagagctgaagggactgcctgaggccacactgttgggaagaatcaaggccaggagcctaggactgtcccaggctccagctcccaggcctgccaggtgagttcccgggacagtcctgggagcagtccgtggccgcccctggaatgtgctgcttcttctccctcagatgtggaagttcacgcagagccgctgggtggttaggaaagaggtggcaaccgtgaccaaagtaagtggcgtttttgtggtctgaggcccaggctgctgctggaggggagggggctggctgtgcctcacgctgggccccctcccctccagctctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaagtaagcaccctgggccagggaggggcagcccggtgatcccagcaaccctgcatcctggggagcactgtcagggtggatccgagcaatctctagaaaccccacatctggggagagcgcagttgggctggatctgggtgtgaagggcaggtgggggtccgcaggccccacgctcctcacccacactgataggcattgctggctgatcccaccatcctttcagcacaggacacacagccagtacctgctcatcagggtggccgtgctctgagggctcagggaagagggatgtgatggagagagggagcactcaggagcaagagctggggcctggggaccagaggggtgttggcagaagactgatggggtctgggtggtcctggggctgtgcactctgccagaagagggactcagtagggctggctgagctccaagcctgcgctgtcagtaaccagcgtgtcctggggcctaaggggtggttgtttctcttgtgaagcagatggtaggggacgtggtttaaagttaatggggttactcttcttttcagactggaaaaagtctataatcttgtaaaggaaaccatgccaaagaagccggatgcacaatcaggtgtgtgaggggctttgggctgggaggccccggctcctacactgtggctccggaagggctgctgtgctagagcttgtcaggcccggacctggagagggtggagggctctcaccgttcacccttcaccctccttcctttcctgccacccacagaccgcagctggtcgcttgcccagcagcagagcctcagggacggaggcttgcggattccagggctgagtctgggttccaggtctctgaggctcactcaccctcttgggtcaacaagcgggcccggaagagctgctggggggaggaactcagcagcacccttccccgcatgactctcggcacgctgggacggttctctcttccactgatggggtggctgattttcgagaaaggttggggatgagaccaggacgggaccacttgctgcagccccgcggtcccctgctgggcttttggcttcagatccctgtgccctcctgagcagtgctgcctccctccccgcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgcctgtaagtagagccctgcctgccaggggcatggggggtggggggtggggagaaccagctgttgggaggccacgtggggacacgggaggccatgcttggtgagcatctgctctcacgtgggcctaggtgtgacatgggcaagtcagcctctctgaggctctattctcatgaaatgggatcatgttgggttttatgtcacaggactgtggtaggggctaaatacggtgtctgaaggcccggcctattgcctggcctgcagcagggcctagtgaaacagggcccctgcctggtttctcaccctgtcccccaccaagaacacctgtttcctactagctttgccattgtttggaatgatttaacttctaagatcgtttgatcttctttgcaatctgcagatgaagaaactgaggctccaaggaatgaaatgtacgtttaaaggtcactacctaggaggtagtagagctggaatttggacctcagtatagtggcctggagttttgaatcctttctgctcagctaagatgagctgcttccccacagctgcgccacgccccagcttgggcctgggtcctggcggcctccctgtgcatcagaagcaagctgaccagctcagcgctgtgctctcagcacttccagtgccaggccttgagtgtggtattgcaagcctcctgccccttccccctgggctgcttttctgtcactgggaggggccctgacgggggagcagagtgcttgctggggaccgtttccctgcgctgaggatagagagcgccaggtgctgcctgaggcacgcctttcccgtgctccttttccacaaggctctgcccagacctggcagcaaaatggggtgaggtggggctgtggtggtctctaagaaagcattgatgttttcattgccaaggtcaggagcgggcctgcagccttgggtgatgatctgaggccaaggcccatccctgtgtatgaggaatagaaactaggacaggaggccttgtggagcctaggctgtctcaggggatcggccctgctggcaggcagccccctgtgggaggtactggcagagttcggagctcctgcccacccagcacatgggtctgggtctccacaagctcacctttcttcatgagctgggccaggacaggcaggacacctgcctgacattagttgttttgggccgctggagtggacagaggtgaggggtgggacatggccaccctcagacaccctcacccctccttccggaccccctctgtccatgttgctttggggtggggccagcgtctccaggagacaccatggccctaactgtaatgctctccttgccatcctgacaaggagactgtattgtagtcacatccaagacgtaagagacctccgatcccagccacctctgtgttgtacatgagggagctgaggtccagggcaagtgaatagatcgagaacttgacttgaactcctggttctgctgcttattagctgtgtgaccatggacagtgagcaaacctctctgagcttacttttccccatgtactacctccccagtttctaatgctcaaatgcaaatgtgtattggaggcctcacagggcttttactggtagtaaccattattgctacttgtgtgatggaaccaggactggaaactaccatcccagatgccccctcccctgtccccttctctccaggacccaggcctgtgtcacacttgtcctggtctacctttggaccaagtggcctggattgcttgggagtcaggcagtgcctctaacccacactgacatggtacatgtgggaagcagttgaaaagaacccccagggtaccccaagagttatggggaagggggcgcccctccatcagggttggcatcttcaggagggaggactctgggtgttaaagcacagttgagttggtgccaggctgatgggaaacagacgcagcttccccactgtacggaggatatctgcagactcgaagccgggcatttcactgggcccatcacactccccctctcgctgaagccctgtcaggccctggggggtgtgctggcctcctccccatggtgaggtgagaggcacaggtttgtggctgcccaaggccctcagagatggtgagtagcagaagctgggattggaacccatgttcctgcatctgggctggggcagacagggagggatgaggcaagcaaatggatccatggggtagagatggacaagcaactcacccctgggccttggtcagtttcccccccagactgctgcttccccggatgagcagaaggtgtttgccctctgggagtctggagacatgagtgatcaggtgaggtgaactttgctgccatcttcccgaagagccaggggggtttcctgcagcgttggaggccttgggggacatgtgcacccaaagtgcagccacacatttcagattttctggcacactcggttttaaatatcctgctccaactctgtacgctaacaaaataagctgtatgtgccaatagtttgaacctaaaccagtggttcccagatgccagtctgtgagccagctccatcagaatcatcttttaaaaaatacaggctgggcgtagtggctcacgcctgtaatcccagcactttgggaggccaaggtgggtggatcacctgaggttgggagtttgacaccagcctgaccaatatggtgaaaccccatctctactaaaaatgcccatagtcgtgggaggctgagacagaattgcttgaacctgggagagagaggttgcagtgaaccgagattgcaccactgcactccagactgggcgacagagcaagactgtgtctcagaaagaaaaaaaaaaaaaacatagattcagttctgttcagtaggtatgcggtactgtcctaggtatctgaatttctgtaaagcttcctgagcaactctgatccagccaggcttatagagcactggtgaagcacatttctcaggcggcctctggcagcaggaatcaaaaggattccttgtcagatgtcaggtcctggacttttaggttaaagaaattggtcattttgcctctagtcatactgtgatggggagggtcacaggtgtccagtgcccagaaatgtgagtggaagcagcagcgccttgcgtgtgtgtggtgtagtcatggaccctgcatcccagcttttcttaggccgtgaacgtacctaatttgatggtcgaaacgccagtcggtctgaccgtgtctaggccctgctcctaaggtgtggggagaagggagtcagcagaaatcccactgagctctctgtccccagctgcctcttaggggagccaactggcaggctgaggatctaaggggctggggccttttcctgagcaagcttgagtgcttttgtccagaatagagggtatctgaaatactttgataacaaaaaggcaaaaaaacaaaagtcataaatgcagatttttaaacatcaaatcagactagaagttttaataggaaagctcttgcactgctggacctgactgccacccctcagaggtgaccacttttattactacttttttaatagaaacagggtctcactatgttggccaggctagtcttgaactcctggcctcaagcagttctcctgcctcagcctcccaaagtgctaggatcataggcatttacatcaccaaaagataccactaaaatagctgcccccatttaaaaaaaaaaatcagcctgtcattagcaatgggcttcccattgtggtggatgagatttagctctcaactattttaggagactgtagagatagatatgttacgccagttttttttttttttttgagatagatagcgtcttgctcttgctcttgctctgtcatctaggcctggagtgcagtggtgccatctcagctcacgcctcttgcgttcaagcgattcttgtgcctcagccacccgggtagctgggattacgggcttgtgctgcctcacccagctaatttttgtatttttagtagagatcgcggtggtaggggtcggggggtggtcccaccatgttggccaggctggtctcgaactcctggcctcaaatgatctgcctgccttggccttccaaagtgctgggattacaagcgtgagccaccacaccaggcctttacctctttttaattggctatcattgtttatagcattgtcacagaatgaactgaaaatctatccattgtagagccaaacatcagtaatatactatgattgcatttccttgttcactgcttcctgttttcacttgtgtaattttctgaacacatgtgtaccgagggtgatactttgcttaattaagcctggttcccgggaagcctctccctctgcttctccagtgagactcgctcttccccatgtctgttgctgaattctggaatctctgcttcttccttgctttagcttctgaagagacagaggagttgtctgcattctttcatgtcttaaaatggattacaatacagtattactgtttgtctgggactagaattttaagaggcaaaggatacttcatgtagcagtcagctgtttacatgaaccatagcaaaaaaaaaggagaatcaaatccatctcctcttaatgtttgcagaaagatgcaaacaaaaccagctaagtatggaacaatgtgtgaggttatcaaagtttctatttttacgtgatcaaatgatttgcctctcaaaattctagtcctagacaaatagtgatacatgaagcatccttttttttttttttttttttttttttttttttttgagacagagtctccctctgtcagccaggctggagtgcaatggcacgatctcggctcactgcaacctccgcctcagcctcctgagtagctgggattataggcgtgtgccaccacgcgtggctgatttttgtatttttagtagagacggagtttcaccacgttggacaggctggtctcgaactcctgacctcaggtaatccgcctgcctcggtctccccaagtgctgggattgcaggcgtgagcctctgcgcccggcatgaagcatctttaagagagtttccattgtttaagttttcagagttgttgaaattccataacattctccttcttggtcttttaaatttggcctgtattctttcctttatgccaaactgcagaatttttcattattctgtatatcagtcagtgccatttcagctgtgccctggtgcgggtcattattgtactagacaattgagttcttataaaatcctgtgagttgttacttttttttgtttttttcagaattcttatgacagatattagacatactgaatccaatcttttccatttttattttggggtgtaacgtattttacggcatcctgtttcatggatgcagtggcatgtttgtgcattaagacttcacaccaattttgacaccctcttctcatctccgtgcagcttagattgtcgcttcacctgcttgctaagtccgatgcacgcctgcattttaccatgcagaaatatgttcaagccactcatcctctcatgtctcttcaccagttcttttgttatgctggcatatacctttgtttttatttatattcaagtttccagacatagcattaatgcctttacttttgtgtttttatttctgtacactgtcttgctgggtctctagagatgacttggctcatctttaaccagaggtgctgcgtgagggtttttatcagagactgcaacacaaagtcaggtgcatggcttgggtgtcttgtttggggatgtttctctttttagatcactgtttcccatcataacgtgtttttgctactaaagcatcgacaggttttgcttgaaattttttccaaaaattaccgggtacgccgaaacatgatccagtctcggttgactcaagagtgtggagaagatctcagtaaacaggaggtggataaagtactaaaggtacatccattttgtgcataacaaacaatatcaaaggctctggaaggggctgacagtgtgtagaagggactctagtgtctttgtgtatatgaaatcaggcttccttgggaccactccccagtcagtcttgtcttgagcaactgttaatgattgattgattggcattggttggggaagggggtatgtgccagaggactgaccccttcaaacaatatagtcacagtggtgtccaagggaaagaatacagccatggatgctttgtttctctttctggttgggccaggccagtaatgcccctttcatccctcttctctgcttgtcactagagacagaaactaaaaaccatggcttcaggctgctaagagcctaaaacaatagaacaacaaaaaaatatggtaggttggatgagcttggcagtgggtaggcgtcttctaaaatgatagggcctagttgagaatcctcactctactctcccttgaattttgaactatcttctgattgttgccatagccacacacatgactttcagtagaatccattcttaaatttagtttaaaaaggaatatgatctgtttactatatgaaagcacctaatgtacaacctataatgcttttctgaagtgactgtagtacaaataccaaccatatttgcagcaacactgagagacagaaaactgatgacaatgtcttgttttgattaaacatccagagccatataagtaatactgttttttaagcacccttgttctgggcatgtcagtatctgtatttcgtagacccccttttttttttttttttttttttttgagatggagttttgctcttgttgcccaggctagagtgcagtagcacaatctcggctcaccgcaacctctacctcccagtttcaagcaattctcctgcctcagcctcctaagtagctgggattacaggtgtgagccaccatgcctggcccaccctcacttttaaaatgcccctgaggaatggccaggcgcggtggctcacacctgtaatcccagcgctttgggaggctgaggtgggtgggtcacttgaggtcaggagtttgagaccagcctgaccaacatggagaaaccccatctctactaaaaatacaaaattagccaggcgtagtggtacatgcctgtaatcccagctacttgggaggctgaggcaggagaatcgcttgaacctgggaggcagaggctgcagtgagccaagatcatgccgttgcactccagcctgggtaacaagagcaaaactctgtttcaaaaaaaaaaaaaaacactacccctgaggaaagggtggctggtagtagccatggtggtatggttaggcagtttttgatttcccatttgtattctattcactaatcataaatcgagtgttgacattgtggacagaatgtaattagctccttttcctgcaaaaatctgtgcttaccctgtttctctctcataggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaactagcatcatggtgctatcttcaaatggttacaggaaggcgatcttgttgggctcagcgttacgtgtatctagagggaacggagctaatggaggaagacagagcagcactgtccactagaaagaggcgagtcacgtacataattttgaaagtttctagcaaccacattagtttaaaaaggtcatgttagcatattatttagctcaaaatatctaaaacatcaacataaggtaaaagtcttcaaaatctggcattttacactttcctcaacactcagtttggactagccacatcataagtgctccgatgccacatggggctatttgcgacagtattggatagcacagccctagaaactgatggaaaaaataagagtaagctaggttggatgacatgtgaattttggtatctagataaggctttcgccatcttttttgtacaacacagtcactaattgtctgaaggtttaaatgacggtctatgctatttccccactccccccaaaataaaacatctaatattttagctatagaatcactaaggcattgatcaaggatgtactttgccaaataagtatttggtaacatcacttaacaagttgatcgtgtattgattctgttaacatatgtgaacctgaaaagtaaagttaccaaaagcgatttggaatatgtctcagcttttccatcctacttccttctcactttgaaaggggaaatgctcatgtgggacggcacagaatgttagtcccatcaccttgcagaacttaattggctcagtggagaagtcagagccttaaatactttacattgataaaaagaactggttaaaacaccaaactcaaatagcaagaaaaagaaacaaggaatataggagggaactattgttttaaaaaaaattgagggaacttgggatgtcagaataggactttccagcactcatccccctgcagaaacatgaatttaaacaactgtccacacacaaaaataccttcacaagagttaaggaacctctagagattacagcaccttggtgtaccacagaaataagatgtactaaagaggataggagggacaattttacattacctagcttaccccctccccagccccaggcagcacagggtggagagagagagagagagagagagagagagaccctctacttggaggaaggagaacattggaccccaaaatcatgccagccccagactccaggcctgcgccaggaacacaggctctaagcatacccactgccaggcctgcacccatgagctcacactctagcaggcaccccctccccaccctggtccagccccatctgagtaaaccccagcactgggctggccctcacagactaggctccaatatcccctgcagccccaggttctaggccagcccccatggccccaggatccaagcgagccctcagagactaatctccaggccagtatctatatacccctggctccaggctgatctatatgcccccatgccagcacccacaatcccaggctccagtacaatacccctggacccaaggtccatgtgtgcctcagcaccaggctccagtggacccaggttccaggcacatacctcagtaagcctcaatgccaggcatgccctggcggactgaggctccagaacagtccctatggacccagaacctaggcccacccctgcaggtttttaggcttcaggtcagctccctggatgcaggctccaggcctgcccttgtggactcaggctctggttgtacccctgcagacccaatcaactggcccactccactggacctacgttccaggattaatcctatgcatgcaagcaccaggctcatccatctgctgacctaggtactaggtcagcctgctcaaggactccagcaacaagcctgcccacagaagaccacaccagacaacttgcccagaatctctgaatgggctcactggtaaacggctgttccaggcaaagtcagactgcaaagattagaatcagtccttaccacttcatccaatgtacagacatcaacatatgaccacaaggatcaagaacaatcagggagacatgctatcaccaaagtaacaaaataaagcaccagaaatctaccctaaagaaatggagatttatgaactgcctgacaactcaaaatagttttaaggaagttcagcaaacttcaagaaaatacacagatataactcaacaaaataaagaaaaccaaatcaagaaacctaatagattgaagttatatattttttacaaaccattctgaagctgaaaaataatatgaatgaaatgaaaaatggaatagtgagcatcaacagaattgatcaagcagagaatctatgaactcaaagacagattatttgaaaatatagccagaagaacaaaaagaatgaaaaggaatgaagaaagcttaagggatttataggacagcatcaaaagagcaaatatttgagttatagaagttcagtaaggagaagaaagaaataaatcacaaaatagtagcagaaaaccttccagatctggagaaagatataaatatccaggtataagagtatcaaaagtctccaatcagattcagtatgaacaaaactataccacgacacattataatgaaattgtcaaaaatcaaaagacaaaggggaagatcctaaaagcagctagagaaaagaagcagatcacatataagggagttccaataaggctagcacttctcagcagaaaccttacaggccaggagagagtaggatgatatattcagagtgctaaaggagaacaaattgccaaccatgaatactttatccagcaaaacttcagaaatggagaaaaagacattcccagacagacaaaagctgaagcatttcatcatcaccagctctgtgtttacaaaaaaatgtgaaagggagttcaagctggtagaaaaggatgttaattagtaacatgaaaacatatgaaagtataaacctggtaaaagcataatgtcaaactcaagaatactctaatactgtaatggtggtatatatattgcttatctttagtataaaggttaaaagataaaactattaatagctaatttgttaagggatacaaaatataaaacttgtaaattgtgacctcaaaaacaaaatgtgggagagagaataaagtatagtttttaatgcaatcaaagttatctgcttaaaatagtctgctatcactgtgttttacataagcttcatgataaccacaaagcaaaaacctatagcagatatgcaaaagataaaaaggaatcaaagcatacctctaaagaaaataaatcacaaaggaagacagtaagagagaaacaaaggatctacaaaacaaccagaaaacaacaaaattgcagtagtaactccttacctaccaacagggataggtaaggagttactactgtgaatgtaaatggattaaattctccaatccatttactgtgaatgtaaatggtttaactcttccataatccaaaaacggagtggctggattaaaaaaaaaaaaaagatctaactatatgctgccaaaaagtgtctcatttaacctgtaagggacacatagagactgaaagtgaaggaatggaaaatggcatttcatgcaaatagaaaccaaaagagaacaagagagctatacttacattagataaaacaaactttaagtcaaaactgtaaaatgagacaaggtcacagtataatgataaaggggtcacttaacaactgtaaatattcactcaatatctgagcacctaaatatagaaagcaaatatgaatagctctgaatggagagacagactgtaatacaataatagtaggggatttcaatatcccactttcagtaatggacagatcaaggccaaaaaaaaaaaaaaaaatcaataagaaagcatcagattttacacattaaacaaaatggacctaccatatacaggagattccatccaacagcagaatacacattcttctcgagcatacatggaatattctccaggacagatcatatattagggcggtatcttttctgaccacaatggtatgaaactagaaatcagtaacaggaggaatttcagaaaatttacaaatacgtggaaattaaacatgctcctgaacaacaaataggccaatgaaaaaaactaaaaggaaaaattttaaaaatatcttgagacaaaaatggacacaaaacatgaaatacaacaaaagcagctctgagacagaagtttatagcaatccccacccacatcagaaagaaaagacttcagataaacaacccaatgttacacctcaaggcaccaggaaaataaaaagaactaggcccagttaataaaaggaaataggccaggtgaggtggctcacacctgtaatcccagcactttgggaggccaaggtgggcagatcacctgaggtcaggggtttgagactagcctgaccaacatggaaaaaccccatctctactaaaaatgcaaaaaaattagccatgtatggtgacacgctcctatagtcccagctactcgggaggctgaggcagaagaatcgcttgaacctgggagacggaggttgcagtgagatgagattacgctactgcactccagcctgggtaacagagcaagactccatctcaaaaatacatacatatatacataaatggaaataataaagaccagagcaagactacgtctcaaaaataaataaaagaaaggaaatagtaaagaccagagctgaaaaaaatgaaaagatcaacaaaattcagttggtttcttgaaaagataaaattgacaaacttctagctaagaaaaaatagagaagactctcatagaattagaaatggaaaaagataatcccagcactttgggaggccaaggcaggtggatcacctgaggtcaggagtttgagatcagcctggtcaatatggtgaaccccatctctactaaaaaatacaaaaatttgctgggcatggtggcaggcacctgtaatcccagctacttgggaggctgaggtaggagaatcacttgagcctgggaagggaatgttgtagtgagctgagatcccaccactgcactccagcttgggcgataagagtgagaccttgtaagaaagaaagaaagaaaggaaagaagggagagggagaagggaagacattacaactgattccatagaaatacaaaggatcaggccaggcacggtggctcatgcctgtaatcccagcactttgggaggccaaggtgggcggatcacttgaggtcaggagtttgagaccaccctggtcaaagtggtgaaaccctgtctctactaaaaatacaaaaaattagccaggcatgctagcaggttcctgtaatcccagctacttgggaggctgaggcaggagaatcacttgaacccgggaggcagaagttgcagtgagccaagaccatgccattgcactctagcctaggcaacatgagcaaaactccatctcgaaaaaaaaaaattagctgggtgtggtggtacatgcctgtaatctcagctacttgggaggcttaggtgggagaattgctggaacccgtgagatggaagttgcagtgagccaagatcacgccactacacactccaacctgggagacagagcaagactctctgtctcaaaaaaaaaaaaaaaaaaaaaaaaaagagaaaagaaaagaaatacaaaggatcctaagagactaccataaaaaattaccagcaaactggataacctacaagaaatggatgagttcctagacacatacagcctaccaagactgaatcacaaagacaccgaaaatctgaccaatgagtaagaaggttgaatcaataattttaaaaagtctgccatcaaagaaaagcccaggacctggtggcatcattgccgaattcaactaaacatttatggaaaactactacctatctttctgaaacttccaaaaatttgatgaagaggaatactttcaaactaattttacaaggccagcactaccctgatatcaaatccagacaaggacactataagaaaagaaaattaggccgagcacagtggctcatgcctgtaatcccaacactgcgaggccaagatgggcagatcacctgaggtcaggagtttgagaacatcctggccaaaatggtgaaaccccgtctctactaaaaattaaccgagagtggtggcgcatgcctgtaataccagctactcaggaagctgaggccggagaatcgctagaacctgggtggcggaggttgcagtgagccaagatcgcgccactgcactccagcctgggcgacagagcgagactccacctaaaaatataaagaaagaaagaaagaaagaaaataaaagcaaattagaccaatatccttatatccttgatgaacacagctgcaaaaacctcaccagaactagcaaaccaaattcagcacattaaaaggctcattcaccaggatcaagtgggatttatcccagtctgggcaatatagcaaaaccccatctctgcaaaaaaaaaaaaaaaaaaaaattttttttttttaattagccaggtgtggtgctgtgtgcctattgtcccagctgcttggaaagctgaggcaggaggactgcttgagcccaggagtttgagactgcagtgagctatgaccaccactgcactccagcctgagtgacagagtgagaccctgtctccaaaacaaagttggatttatccctgggatgcaaggatggttcaatggttcaacatatgcaaatcaataattgtgatacaccacattaacagaatgaaggacaaaaaccatataatcttctcaatagatgcagaaaaagcatctgaaaattaacaaccattcatgattaaaaaatcaacaaactaagtatagaaggaatgcccactcttacctcttccattcaacaaaacactggaagtcctaactatagcaattgcacaggaaaaataaaaggctggtggctcacgcctgtcatcccagcactttgggaggccgaggcaggcggatcacctgaggtcaggggttcgagaccagcctggcaaacatggtgaaacccccactctactaaaaatacaaaaattggccaggtgtggtggtgataagcctgtaatcccagttacttgggaggctgacgcaggagaattgcttgaacccagaaggcagaggttgcagtgcgctgagattgcgccactgcactccagcctgggagacagagtgagactctggagaaaaaaaaaaaaaaaaaggcatccaaatcagaaagaaagaagtcaaattgttcctgcttgcagatgacatgattttatacatagaaaatgtgtgtatctacatgcaaaagaatgaagttgaactcttatcttacaccttacacaaaaatcaactcaaaatggattaaaaacctatttttaggctgggcacagtggctcacacctgtaatcccagcactttgggaggctgaggcaagcggatcactttaggtcaggagtttgagaccagcctggccaacatggcagaaccccgactctaccaaaaatacaaaaaattagcaaggcgtggtggagcatgcctataatcccagctactctggaggctaaggcaggagaatcactagaacctaagagatggaggttacagtgagccaagatcgcaccacaactccagcctggaggacagagcgagacaccatctcaaaaacaaaaacaaactaacaaaaaaacctattttaagaactgaaaccataaaaccttaagaaaaaaaaatagaggaaaaggtctttgacattaaccttggcaatgatgttttgactgggacaccaaaagcacagacaaccaaagcaaaaacacaacaggactacctcaaacaaaagcttctgtacagcaaaggaaacaacatgaaaaggcagcctacgcactgggagaaaatacttgcaaactatatatctaataaggggttactaaccaaaatatatagggaactcaatagcattcaaatgaataacctgattttaaaatgggcaaagcatctgaatagacatttcttcaaagacataaaaatggccagcagggatatagctgctcaacatcactaatcaagaaaatgcaaataaaaaccacaatgagatatctcacgttaggatagcttttatcaaaaagacaagaaatagcaagtggtgaagttgtagagaaaactgaacatttgtacactgttgatcagaatgcagattggtgctgcactgtggaaaacagtatggatgctcttaaagatagaactaccatatgatacagcaatccctcttctgggcacatgcctaaaggaaatgaaatcaccaccttgtaaagacaactctgtccccatgttcattgcagcattattcacaggagccaacatatggaaacaaccaaggtgtccatcaacagatgaatggataaagaaattatgctataataatatacatacataccatggaacttcagcattaaaaagggaggtcctgccatttgcaacaacagggatgaagctggaggaagacatcatgttaaatgaaataagctaaacacaggaagaaaaatactgcatgatcccacttatatgtagaatcttaaaaacaaacatcatcaacaacaacaaaaacagtaaaatagtggttaccaggggtgggggaaatgggaagaggcaagtcaacgttgcagttatgtgggatggacaagcctaagagatctaatagacaacatgagggcttctagttaataaaattgtatcatatactggtaacttgccaagagagttgattttaggtactcttatcacatacacgggtatgttatgatgggtatgttaatttgcttgatcttagtaatcactgtatatatcaagtatatcaaaacattgaacatattaaatatatacaataaaaagaacataagaggatacagacatgtatataacaaaggaaagagaaaaatgaaaataaacaagttttatttgatgaaacaacaaaaatatgtatagttctttttctttttttagagacaggatcccactatattgcccaggctggagtacagtggctattcacaggtgcgataatagtgcatcatagccttgaactcctgggctctagtgatcctcttgcctcagcctgccaaatagctgggactataggtgcacaccactgtgcctgtctcatttttgatataaattcttaaaacaggaatagatggattcctgattaattaaaaaaaatccaacattatgctaaatcaaacaatggacatattgtttaggattcagacaagcaattttactcccaccatatttaatattctggatatttcagagcatttaaacaagaataagtgtaaaaattaagtagccaaacaatatttttccaggtatatcaaaagagtcaaataaaagatattcccccatgataattcaacaagatagctgaaatcaatagcttttctatacacaactagttacaaagtatagcaggagaagaatcccacttaaaacatccaagagacaaacctttaaaaatatgcgagacataaatggtaaaaatttgaaaactgagacatacaaagaccattggaacaaatggaaaaacacataaccgttcatgaccagcctggccaacatggtgaaaccccgtctctactaaaaatacaaaaattagctgggcatggtggtgggagcctgtaatcccagctactcgggaggcagaggtttcagtgagccaagaatgcaccactgcacttcagcctgggtgacagagtgagaccccatctcaaaaaaaagacatatagccatgtttttggatagaagcctccgtatgattaagcctgttcttattaatctatttatttaacttgatcttgataaaagtaccaatttcccctcaagaaccagacaagctaattttaaagctcatatggggaaaaaaaatgcaaaaaaaaaaaaaaaaaaccaggaaaatcctgaaagagtaatgagagtttaacttccccttagcagttatgaaaatataaatatccaagtacagcaacttaaaactacaaaataagacaataaaaaataaaaatttaaaactgcattaggtacatgaaaatcagatcctagaagaaataggttaaaattcatgtagacatttagtactaatatgggtggcatttcaagcgttggtggatagacttcagatggatcaaagaactctcaaacacaaaaagagacgtgttaaagattcatatacataaaagtgtccaggtgtggtggctcacacctgtagtcctagcactttgggaggccaaggcaggcagaacacttgaggccaggagttcgagaccagcctggccaacacggcaaaaccccatctctattaaaaatacaaaaagttagccaggtatggtggcacgtgcctgcagtcccagctattcaacttgggaaggctgaggcacgcgaattacatgaacccgggaagtggaggttgcagtgagttgagatcgtgccattgcactccagcctgggcaacagagtgagatgctgtctgcccccgctctaaaaaaaaaaaaaaaaattttttttcatatacataaaattgtgcttggtgaaaaaaaaatgccattaacaaggtaaaaactgctgggtgtggtggctcgtgcctgtaatcccaggagttgcctttggagttacctttgggaggccaaggcagggcagattgcttgagcccaggagttcgagaccagcctgggcaacaaggcaaaaccccatctctaccaaaagttaaaaaattagctgggcatggtggcacgcacctctggtaggaaggctgaggtgggaggattgcttgggcccataagtcaagggctgcagtgagccgtgttcatgccaccacgctccagcctaggcaacagagcaagaccttctcaaaaaaacaaaaaacaaaaaaaaaccacacacaacaaaaaaatcagataaaaattaagataatctgggacaaaacactttcaaacttctaactgcaaaactgcatatataaatagagctctttaaataggcaaaggagactacaaatggctaacagattaaaaaatattgtcttattaatagaaatgcaaactgtttttaaataagctatactattcaaacattaatagtatagtttgaatagtatagtttgaatagtatagtttctttgctatggttgatcaaatgttttgagaatcaatttgtcaaatgctattaattcagaaccaagtctgacatttctgaaatagtgaaaattacagagtatataaatttgaaaatgtttgtccagagtagttttaatgagcatttagcaatatgagcagaatttgtgctattaagttacacaaatccaaggattccctgtttaaaataggaaaaaaaaaatcactgcaaatctttctcgcgatatttgttggaagaaaaaaagtgaacagttggttataagagcgaaatggcttatattgaaagtaagacacagatccatctgttcattttcataggtagctttatttggtttttagaaaaatatatacaataatcggaacatcagttcttaaatagttttaagttaaaagaatgcaagtgagaggatgtttccacagtcagatcaatactgcttaataaagtagataggaatttctgcaacaagtcaaaacatttacaggaatggtaagaactctgcaagagcagcttgtggctggcaagtcagccagctcagaaaacaggtaggaagggaaggggtttgatctttcccctttagtttgaatttgagaaagtgataaaagatttacatattcacctatcctaaaggctagagctttgagtaaaaacattagaatacagggatggaggccctctagggcatatgctaacaagctaacttatatcaaacaaaaatttgccatctcaatttggtattcagttggatttggatatattaggattacctgtcagtcacagttcaactagttcagatataacaaaactcaaggacttggagtattggttaatgacatttcttttggattagacccctgctttctctcgaacattcttcgtaatgaattcacagtattcaaactgtttgcaaagatatttgagtttgacagccttctgactttcatcgttttgagaagttgcgcaaggaagcaataggaattgccttagctttgttctaactcgacccttttcccccatactgtagtaactccaggcctacttctccagaagtatagctcttccctccactggtccttttcaggaactgaagtctaatcagcgcgccagccagaggccagtttgtcatgggatttcctggggagcttaaatggaagtggatcagagaactgataccactagccacctcctttcctcgttgtatgcatttgctaaataagcaaagcaatgaggcaaacgtcatgagtaacattaggcttcagagtctacaaacacttgtctgaatgggagagagaggcgataggcaataggcaaattagtagtagagctagaggttcaattaagaatgagaggagagtgatcggtattttgttctctgttcatctatttcctgcttagttttcttgatgcaactaaagatctccttaaacaacgctttgtattctggaggtgttgtaggggaactcacgggctctgggttgacagaggccagttcccagccgctggcaacaggctcagactgggcgttcactccagtcaggtccttggctgcagccctggaggtctgcacagccttgtgtgacagggagtcctgttcctcttggcacttcttcagcaactcttcatacttcaccttcagggcgctgtactgcgtgtccacttcgtgcagaagggagatgcccctctgtttcacagccttggccctcctgatgcaggtctcctcgtggcccttcacgatgtcactccctgccaagctgctgaggatcgtctcactgctgctgcgcttgagaggctttctatgtgattccggcacagtcaggaacatctcttccagcaggctctggctgggctctttgaaaggaacatacagagagtctggcaccagcttctcaactccattcacaaatggatgctctgactgcaacatctgtcgcatctctgccacctcggcctctagttccagcgcccgtgctcggtaggcacctgtggcccccagctgctgctccagttcactgttctcctttaacacgagcccatattcctcctccatagtcacccgcttctgccgctccaggctcagctgggcctgcaacattgtcactgtttttttcaagtgctcattttcctcttcatcagggcttggctgaccttgcaaggaagtgatcttctcagcgaacacatgatcatacacgaagtgtctagggaaaaaaatattgaaagaatatattacacaggtccactgaaaatgacgagaggaagactggtgattttttttcaactaaataaatttgaggagctgtgacagtgactaatttttttttctttttttttgagacggagtctcactttgtcgccaggctggagtgcagtgaagcgatctcagctcattgcaacctcagcctcccaggttcaagcgattctcctgcctcagcctcccgagtaactgggattttagacatgcgccaccacgcccagctaattttgtatttttagtagagacggggtttctccatgttggtcaggctggtctcgaactcccaacctcaggtgatcctcctgccttagcctcccaaagtgctgggattacagacgtaagccaccacacccggccaacagtgattggtttttagccacacttggagcagtggctaaaatggaattgtgtgaggctggtaaataaacacatgaaagcaaactcaatttttgtgacaaatctttttttaatgttaaaagtactagagaacatctattctagcagtatgacaatgacctcacaagggaaaccttaaaaagtactggtgcctgggtcccaacccacagattccaacctagttggtctgctacctggcctgagggtttctaaaggctctccaaatgattcataatatgtaactacgattgaatcactacagcaaattactgttgctgtggtgatttttaaccaggaatgttcatcagaattgcctgggcagctttttacccgcacctagaaattctgatttaggcctgaggaaatgtgttggtatttgcattttgaaaaaccccacaggtgatctgatgtacagccaaggttgagacccaccaaatgaaccacctggtttctcctgctcagtctgaagcaccttgactatttatttgtgtttttatttgcttatctgccgttccgttagactgaaagctcacaggggtagaaactattttgctcgccaacccttgggtctagcatacagcttgccacacaagtgttccataaatacttcttaaagattcagacttataactctaaattataaaggtacttctttaagcaaaaaatctcctgttcgcttgaatttttgttttaccagtatttctgtttttcttcactctaatgtaaaacacaactcccaaatctagtctatcagaattcatcttaaactatgatttaatacattaaaaacactgaaataagtgttccaagactttcaaaatgagaactactaatatctaagaactctgtaatttatatgtttaagtgattttgttcaaaccaatggtagcttaatagctaagtgacttttcttaaaatggtactttcaatctactggaaatcagaatgtgccaatgacatgagacagtccctgctgtaactccacagaaaggcaggctcttactggcggaggtcatacagctccttcagacatgcaaagctgggtgccggtttctcctggtcacactttcccgggctccttctcccttggccagatgacttcagctcctccacttggctctggaggtgatcaatgttggtttgcaggcattcaatcgtttcagtcaggctgtgaggaacagacagaagccactgctgcttgtcatattgaatcaagggcaaaagcggtgaggagagattaggtgcaaaccactcacactgggctttcttaattggaaaggatgtctatttaatctccattctccaaaaagaattaaattaaaccttatcccatattgacccaaacccactgcagccatgttctattctagtttatactaaagaacttccccctagtccttccttgtcagattctagaaaatttacctcagaatcttttgctgtgaggccttgctgtcagcaactagcttttgatttgtttcttccagttcccttgctgtgacgtctaattgttcataaacctttgcatgttgttcgttcatctgccgtagaagttccacttgcttcgtcagatactgtaagagaagatcaggaccaggtgacacaaacagataagatacctgctgtttcttggctggctgcggtggctcacgcctgtaatcccagcactttgggaggccaagacgtgtggatcacctgaggttaggaattcgagaccagcctgaccaacatgctgaaaccccgtctccactaaaaatacaaaaattagccaggtgtggtggcacacgcctgtaatcccagctacttgggaggctgaggcaggaaaattgcttgaacctggaagacagaggttgcaatgagccgagatggcgccattgcactccagcctgggcaacaagaatgaaactccatctcaaaaaaaaaaaaaagatacctgctgttctgctgttccaacaccaattctccgattgtcagcaccaactcttgttggggtggggctgacatagagtctccatctctgggctcactggcctcccagcactgcccagaagctcctttagacccatttcagttttctccaggtcttctctcacatcagcatgattgattcaattattggccattggtgactgaactcaagctccaacccttccctctatccagaggttgtggggctgggactgatagatctaaccctctaatcatgtggttgccttctctggtgaccagacctcaacctatcaggaaattccaagggttttaggagttctatgccagaaaccagggacaaagaccaaatatataatttttattataccacaataccatatgtttattttaagaaaagaagaaattaaactccctgtcttcataagaaatgagcacaggctgtcctttatatgcttagctcctctaatgctcaccaataccccagtgcattgtgaggctaattttccaaagcatataccatgcataaaattaatattcaactaaaaaatctaaagtgagacataacaatcccttaagacaaaaaacatggaacatgtgatcaaagtttaagcaaaaacatcatgtttaacagaaataaagcctaacgtggaggatttttaaaaaaaattatactctaagttctagggtacatgtgcacaatgtgcaggtttgatacataggtatacatgtgacatgttggtttgctgcacccatcaactcatcatttacattaggtatttctcctaatgctatccccaccccgacaggccccagtgtgtgatgttccccaccctgtgcccaaatgatctcgttgttcaattcccacctatgagtgagaacatgcagtgtttggttttctgtccttgtgatagtttgctgagaatgatggtttccggcttcatccatgtccctgcaaaggacatgaactcatccttttttatggctgcatagtattccatggtgtacatgtgccacattttcttaatccagtctatcaactgatggacatttgggttggttccaagtctttgctattgtgaatagtgccgcaataaacatacgtgtgcatgcgtctttatagcagcatgatttatgatactttgggtacatacccagtaatgggactgctgggtcaaatggtaattctagttctagatccttgaggaattgacaccctgtcttccacaatggttgaactaatttacactcccaccaacagtgtaaaacgttcctatttctatgtggaggatcttaatttggaaaaaaaaatcaatctctttctctgaatgaggcattctggaccaaaaaaaatgaaaagtatgttgctttgacgagaaatatattttagcttaatatgcttcaaagactcctgttatttttaattttatgagagttttatcaccattatcctccttattcacgagaaatttatcagatgatttattctggtcctgctaagactgcttcctaaatggccaaggataaaggggaataatcccaaccttaatgccgcagtgtaagtcaccttgattccctccctgctcagctctacctgaagacactaaaacacagtatatattccaaaggaaaaagtcacagtatttccctggacagaaccagaaagaggggagaaatggtttgaagcttactgatgatcaaactgtaaaagactcagaacttgactttaaaaacactcttcttggccaggcatggtggctcacacctgtaatcccaacactttgggaggccaaaacaggcagattgcttaaggcaggccaggagttcaagaccagcctggccaacatgacaaaaacccacctctaataaaaatacaaaaattagtccggcgtggtggcacgcgcctgtaatcccacgtactcaggaggctgaggcatgagaatcttttgaacgtgggaggtgaacgttgcagtgaaccgagatcgtgccactgcactacagcctgggtgacagagactgtctcaaacacaacacaacacactcttcttgaggctttttctacaactctagaaggatttgcaaggctaacaaacaatgggctaaatgacactcaacgggcccttaaagtgttgaaaaaagcatatatggctttttttttttcaaatccatttacataactcagcagcaaagagttgaacaaacacttaacctaacttcaactttctcatctgaaactcttgaagtcaaaagtgttttggaaaattctttaaattttagaaagacaacatggcgctcatacctgacacacagctgacaccttataatacctgtgaggtctgggcagcaccctgtaatcaagcattaatatttctgcatcaaaaagtatgaactaagactataaacagcctcacatcagttcaggtaaagatctactaccaaatgaatctgttgcaaatttaaggggaaaaaaaaaatcttgctttatagagctttttgagttcggaattagtaagtggatctgttagtacctaccatgtagaactggcagaattaaatgagaaaggtgagcacatggcacggtctataaaagcctgtgtgtagtcttcactgcctcaactcccaccagcttcttctggtcctttggaaatcaaccactaattctcatgcgtgaagctttctcagaactaaaggagtaggcccttaatcctgccctcgggctagtaattccatagtaggttcttgtcattgatgggaacatgttcaatctcttaggaattgatgagattccacaggagcggaaaaaaggcttagaatcacaagaatatatatataatagctgcagaaatgtttcaagcttctttatatcaagtataaattatcaagtattctttaggactcagaactacctttaaaaaggctaatgcataagccagacattaatttattaatatacaacaggaactgttcctgcccagtgacaagaatattcacatcctctattaggacacagctgccccacaaagggcatgtgaaaggccgattcatgaatgagagtctctggtagacatgggatcagaggagtctgatgggaggcagtggtatagtagctaagagcacaggctttggagtcagaacctggtttgaggtcttgctttgctgtttagaactgggtaacctacagcaagcacatttttctaatgtgagttctcctcatcaactacttcataaggctgtaaagataaatatgtgtgtgggagagactggactatgtcaccccaaagcatgcgtctttggcataaaaaggttcctgcctcctccctctctaccagggagaacaaaggttaaccactaacaactttagacctttatgggccagaagacagcaccagaggaatccacactaacaagctttgctaacgggcctttatcaccacttacttgccttcccacaagttctgcccctagacaaagttcttcccctttgtcttgtcacttctctaaaaaattaccattctttgttgaagatactacataagctggaattcaaagccacctctgagaatgactcatcccctgggtatctcccacacatataaatgaaatagatatgttagtaagcttgtttttctcttgttaatctgtcttttgttgcaggggtcctttccaactaagcactcatgaaggttgaggaaaaaaatatttttcctccctgacatatacaaatatataatttacaaaaacgttaatatatgtagagagctcagcatgagatctggcagatggtaaattgctcaataaggagaagctactgtcatctttatttaaagctacagttttcaaactttacatgtgctaagattcacctggaagaagatttattaaagtgtaagaacctgggtcccttcccctcaaacggctgagactggagtagagccaggattctgcatttttagcaacaaacccaggtgatattagtacaggcagtccagagatcacacttagagaaatgttgatcttggacatggaaaatcctggacgtcccctgccctgaccaatgtccttttctcttgggtctaggagacacaggcattcactggatcaatgatgactcttcagcttaatgctcaccgtctccctgcatagggctcagcttagatgcagttatccactaagattaggttatattttaactgtaccacagcagcattcatcatcataacgcttcactttggtatgttcttaacaatcattaattccctgaaattacaaactagttaccttaaccttgcttgagtgatccttcctaacttctcagtccaaacaaatactgaatttctacagatggctaatcttatccactgcattttaaaactttctattgtggaccaggtgtggtggctcatgcctgtaatcccagcactttgggaggccaaggcgggtggatcacttgaggacaggagttcgagaccagcctggccaacatggtgaaactccatctctacttaaaaaaaaaaaaaaaaaattagttaggcatggtggcacacgcctgtagtcccagctacttgggaggctgaggcatgagaatcacttgaacccaggaggcaaaggttgcagtgagataagatcacaccattgcactccagcctgggcgacagagtgagactatgtctaaaaataaataaataaataaaactttctattgtggataatctcaaacatatatacatgcagagaaatggtttaatgaactcccacgtacccatcaaccagtttcaacaattatcaacatacagccaatcttatttcatctctactctcctactttcctcgtcctccaatcattttaaagctaatccaaggcatctcaagtatacatcttcatacatttctaggacgttttattttaaccacaattcctaagggaaaaaaactcaataattccttaacatctattacgtttcagcattaatattttcccaattgtctcaagtggtttttccagcttcatttgttagctattgatttttttaaaatttcacacttaggggagatatctttgccttttttggagttgccccactgcaaggcaagtgcctccctcctctaatgcctttacgatcccctatccggggggatgcagttctcctggctgctccacctaagccagcagttcttagcctggggtccatggatagactttagagggtctgtgaacatggatgaatttaaagggtctgaacagctacatcttcatttttgttaacttctaaatgaaatttgacatttctttcaagtactaatagatctgttaaaatttataggagaccactggtttggactgagtccctgccctaggcccaacaaaccaaaccaaaatggagtcacttgtgctaaagttccatgtcagcaagccaaagcaaagttgttcatctgacttctgagaaattagaagagataatagccaagcccccaaacatgccagttttagccagcataagggacttccctctgctttaacctttacaaataaattaactttgaaaccacccattttttgttttctgtttctgctttcctcagcccctgtctataaaaccaacttcctctgctcagctcattgaaaccctcattctctaagaatgaggtgttgcccaactttagaatctcaaataaaagctaattaagatctttatactatgtttgtcgtaattttttcttttgacagaggcaataaaccactagtagtattaggtttatctgtgacttcatcatcaacagaaatcacaggtattttcatattgcactatagttgcagaaatcttgatttactgcctacattcatcactatttgaaatcatggtagtttctagatcttgttattaaatatgttaatacgtatctatattacatcacaaatttacttttttcaatatttgacaggtatttcattctaacaggtttcctttgtaattcaatgaattttaagaggattatcctagatctcattagataatcaaagggatccatggcaccaaagaaagattataaattccagttatccttctggcctcatttcaaacataacctcttcagaagccttttaagaccactttggccaggtgctgtggctcatggctgtaatcccagcactctgggaggccgaggtgggcagatcacttgaggtcaggagttcgagaccagcctggccaacatggcaaaaccccgtctctactaaaaatacaaaaatttgctgggtgtggtggctcatgcctataatcccagcactttgggaggccgaggcaggtggatcacctgaggtcaggagtttgagaccagcctggccaacatggtgaaaccccatctctactaaaaatacaaaaattcgccgggcatgatggcaggtgcctgtaatcccagctactcaggaggctgaggcaggagaatcacttgaacccaggaggtggaggttgcagtgggccgagatcacgccactgcactccagcctgggggacaagagcaagactttgtctaaaaaataaaataaaataaataaaaatacaaaaattatccaggcaaggtagtgtatgcctgtaatcccagctactctactggggaggctgaagcaggagaattgtttgaacctgcgaggcagaagttgcagtgagccaagatcatgccactgcactccaacctcagcaacagaacaagactccatctcaaaaaaaaaaaagaaaaaaaaaaaaaaaaaagaagaccaccttaaagcaggtctaaagcggcagcattcccaaggtaccctaaattgatttctctcaaaacaatacaataatattcaattttttgttgttgttgagatggagtctcactctgttgcccaggctggaggcacgatctcagctcactgcaatcttggtctcccaggttcaagtgattctgctgcctcagcctcctgagtagctgggattacaggcttgcaccaccacaccaggctaatttttgtatttttattagagactgggtttcaccatgttggccgggctggtcttgaactcctgacctcaggagatccacctgactcggcctgccaaagtgaagggattacaggcatgagccaccgtgccaggccagtactgtagtcttctaagaatggaaggctcttgtgtatctagtccattcctgacacacagtaggggacaaaaaaatactggcgaactggcagtttctagacttttcttcacaacagcttattgtgcttggcatgactcagactgtgagatgtcaagggggatttaactgaaaggttttgagaagggctttggctttagccctcttgggaaaacagcctattaaccatgaattctctccccgcttttccatttatagattatttctctgtatttattcccatggcagcaattgccccggtaatctgagggggagacttttacagttcctaccagataccagatgggtctcaagttgttgttctcttacagataggatgttcaagttagagttgtggccaacatacaggaaacaagtcaatatgcaaataagtacaaacaggccatttaagaaactatagaaagttccttgtttgatatataaaaacctgtgatacctgtgataacaacataatgaaaccatttaagaacttgtgatattttggttttagatgacttggctttaacaacaatctaaagaatgtcaaggagcttgttttcacatggtaggagcttaatcttattatataaaaccaaaattaatcagaaaagcccttcacttctccaagattcagttataggggacctacagaagagtctgacaaaaccagtcagcaacttaaagaaaaatgatgagctctctaagtacgtactgatgtaaggccagacatctaggtctatggagtcagtgcttcattttttttctgaatctagaaggaaatgggttagcttatttcctacctctcatctcaaggtacagacatgctgctgacatgctggttttctctttgatacacagcctccaatgaatctgactgccatagtaaacaggaaagggagacatttaaagcaaaacagtgggggaagggggtcatggggtagcagaaatgtgggcaaaaatgtcaacttatagcaaaatgccttgggtttatctcactgtctaggaatttgcacagactgtcacctcaactatgagtacaaggttccagttatgcacaaaagctacaaacaggccacctttacaattaaggtaaatctttaaaaaacaaaggccagcagaattacataaatacctatttgcaattgtggaatcctaacctggaacgcagggaaagatagaaacaaacgaccccaagtaaaaatgcatagaaatggagtggaaatctggcttgtaagcagtgttgggattatcctgaaattaaggattacagcctaaatcctctgaatttactatcaaaatgaacttccacaataataaagaaatatttcctattacttttgaaaaatctctttcccctgatgaaatatatttcccctgtagaaatttggtggcgggaggcatgaacatgaaaatagaaaccacctataatcccattattaaaattgtgggattagattgtttttaaagtctatttccagtaattctggaagatttattttttcagaatttaagttctttcatgactatagttaacaatatcttattgtatacttcaaaatagctagaaaagatacgcaatattcccaacacaaagaaatgataaatgttggaggtcatggttatctcagtttagatttcatcattacacattgtatgcttgtatcaaaacgtcacaggcgccccagatatatgtaaagctgttatatatccatacaaatttttaaagacttttttcactactaaaattctttttttttttgagacggagtctcgcttttttgctcaggctggactgcagtggcgcaatcttggctcactgcaacctccacctcccgggttcaagcaattctctgcctcagcctcctgagtagctgggattacaggcgcccgccaccacgcccagctaatttttctatttttagcagagatggggtttcgccatcttggccaggcttatcttgaactcctgacctcgtgatctacctgcctcagcctcccaaagtgctgggattacaggagtgagccaccgccaccggctcactactaaaattcttaaaacattggtaaactatgcaacgatttataccgttcaaaatatatatgcttccataatctcatcccctcagaaaaatcctataccaaagtaacaatttatactgttcaaaatatatatgcctccataatctcatcccctcagaaaactcctacaccaaagcagtgtaagcattatcaccattccataacggagcaaagagaatctgaggggtaattcatatgtctaaattctctagctatttgcaattaaaattgagggtttaaacctgaatctcctaaaacagaggccagagccccttctgcctgccttaaaaatctccagaggtggaaacccaaagtttaggagttattagaagagctttgtaagctgtttctcctctgttaaaatactgatttcaacaaagtattgattacctagtatgtgtgaaagaccatgaataaacacaacagtgctcactgttgcaatgggaaataaggggaaaggaaaataaagcaaatcaattaagtatcatatgcagtagaatattgatacatgcagtaaaagcagcacaaaatatttttccatttccaaagagggcatgaactcttgaaagaagggatgccttgaaggccagactactttgagtgctaggcacaactcctgtaggggataatgcaggtgtctaagcagggaagtaaccaaaacacaaggctgtaggctgcttacacggttgtagcaaagtgtaaatgaatccaatggtgtctgatctcattactctcccaagtaagagttctctcctcccctccttccacccagaacagaaaaaacttgctctggattcttaaaaaattatctaagtttttcaaattagcactgaaaaaaagtaagacaggctacaggcttctctgaagccagtttaaccattattttgaatagtttaatcttttttcgttttcacataaaaggaaatttttgtttttttcgtttttacattaaaaatgatgcctaccaaaaatactgatcaatttttaggaggattgtttgaaaccctccaagagtctttgaaagaatatttgtggttctacttacaaaataccctttggcagtgtccaagttgtctatttccataataagtcagaatcttagggatcttgtcctagtattttcaccagttctctgcactatttttcattcgctcagatgagtttgttcccagaccattcttctggactgtctcattttaaatttcactggtggtgggataggagctgactttttgttcttcaactatatatttttctgaattaaaaaaatgatcttttttttttttttttttttttttttttgagacggagtttcactctttcgcccagactggagtgaagtggcaggatctcggctcactgtgacctccgccctgcaggttcaagggattctcctgcctcagcctcccgagtagctgggattacagggatgcaccaccatgcccagctactttttgtatttttagtagagacagggtttcgccatgttggccaggctggtctcgaactcctgacctcagtgatccatccgcctcagcctcccaaagtgctaggattacaggcgtgagccactgcgccaagctgtgtattactttgtaatctaattcccaataaacattctaaacagttactttaaaacttgtacaagtgattccattcacgtaaaggtcaaaaacaagctaaacttaggatgctagctcaccgggtggtgaccagatgagctgataatgctctcaactccttatctaggaataggttgcatgggcatgtttactttatgaaaattcatcaaactatacacttaggatttatgcccttttctgtaatgtagatttcaataaaaagtttaagggaaggagaaacacgttgaaaaggctcaaattaaggagagggcccttataaagtttagggggcctcctgaaggttgcaataagaggaacatatgcaagggtcattgtttagcaaggaagtaggctctttagctgcctggttacttttacaagagcacatggcattcttttaggctattagagagacctcagaaatctacatcgtgatctctacatctgcccaggcacagttgtgatggagcaggcagcaaggacagtctgtgggaatcccctggctggtaagtgggcttagccattactgccatctcatctcccctactgagactggaaacttactttcatgaagcaacttataaaaggaaagaaaaaagaaagtcaactgtaatggtggtgaagaaacctaagagagtaattattcttagccaaaaacagctttggataaagagtaaaatactgcattgtgcaatgctcagatctaggaaccagtggactacatattacaggaacaagagactcatgaatatgtttcccgaaatattccaagctaaatctcctgaatagttttatacatgaattttatacttttttttttttttttttttttgagatggagtctcgctctgtcacccaggctggagtgcagtggcacgatctcggctcactgcaagctccgcctcccgggttcacgccaatctcctgcctcagcctcccaagtagctgggactacaggcgcccgccaccacgcccggctaattttttgtgtttttactagagacggggtttcaccacgttagccaggatggtctcgatttcctgacctcgtgatccacccgccttggcctaccaaagtgctaggattacaggcgtgagccaccgcacccggctgaattttatacctatttaatcatgaaggtctgaactggattatttcatttccatgacgctttgcaatatcttatggataatattagataataaagtgttatttgtagatttagagaatctcagatatctttggatactttcagaataccaatgatctagcttaaatgtttaatcatcctcgataccacagaaaacaaagcagttgtttgtaatctcctatgctaatcaataggcatcattctcccaacttacaaatatttacacttctttcagctacacttgaaagatatgctaaaataagtaccagttatagtgttttataaatgctctaacaggaaacatcaatacaatttattaactattagcaataatcaggcctcggataaacctcatagactacgataatacaattaagactatgtctctacacaaatacaaacagtgatgatcgtttaggactattctgaaatctcccactgagttaaaaaacaaagtctacgaaacaaagtaggaaagagttccttgaccacgtaaaacatttggctagtttaatagttttgtttttagactagagacacggtctcactttgtggcccagtctggtctcaaaccctagcctcaagcaattcttccacttcggcctcccaaagtgctgggattataggcgttagccaccatgcctagcctagtttaatagtttttaaatgcctagtttctctgcattttaggtttctggcaaactctacagtaggtcttttttttttttttttgagatggagtcttgctctgttgcctaggctggagtgcaactgcacaatctcagctcactgcaaccttcacctcccgggttcaagtgattctcctgcctcagtgtcccaagtagctgggattatgggtgcttgccatattttttgtatttttagtacagacaaagtttcaccacattggccagactggtctcgaactcctgacctcaagtgatctgcctgcctctgcctcccaaagtgctgggattacaggcttgagccatcgcgcccggcctacagtaggtcattaaattcaatttagtgtaaaacatattgtacgctcttttgatgtagaatatgctaaaaatggtacctggtgacttcaatatcattgcaagccatactttcctagaattataaaagtgtatttcagaaatcctgctcaaggggagggtctactgtatacaccttttatgttactaggtaaaattaatggatactgagattgcacatttgcctttgttttgatgatagatttgtattcaaaagtttaaaactgtatgatgtgatcacttctaaggaaggactgtgtaattctccgcttgtttgaattcccagcacctggttcaggaaataatcaaagctttagtaagtactcattatgatgaactgcttcactgttctagagtcttttacatttttctgtgcacagacacaaaagtcctgggtctactgtaccaatttaagggggaggagcttataatttaagtacagaccctttttgggggaagcatgggttgggacatggagaaaggtgttctgatgggacactggttaatatccgtgattatctttacagtcaagtggcctacacataactgaactacttgaaggggactatttataagattagcagcatagagggccattttaatgccctagtctagcatctttcattttagtttgttaagctgggcaaaaggtattatattattattatttttttattgagacaaggtctcgctcccatcacctaacctggagtacagtggcacggtcttggctcactgtagccttgacttcccaggttcaggtgattcttccacctctgtctcccaagtaagctgggactacaggcacacgccaccacaccagcctaatttttgtatttttttttgtagagatggggttttaccacgttgcccaggctggtctcgaattcctgagcttgggcaatctgtctccctcggcatcctaaagtgctgagattataggcataagccaccacactcagccaaaaatgtagcattttaataaaatatccagcaaaaatgtaaacaaatcaagatcacagcagagagaaagcaacatgtattttatgattatttgaatggagcaaaacatctgaacacactgtgaaatcaggaactatgatttttttttttcaaatttaggatatggtttggtagtaggtgggagggatatgtcaccaaggaggaggtataagttccctctccggtgggaagttcaagagtgtgggcagtcttcttttttaagctaggtggtggatatatgggtattcactgtattgttctcttaccccattctgtatatcttaaatattgcatgttttaggccgggtgtggtggcccatgcctgtaatcccagcactttgggaggccaaggcaggtggatcatctgaggacaggagttcgagaccagcctggctaacacagtgaaaccccatctctaccaaaaatacaaaaattagccaggcgtggtggcaggcgcctgtaatcccagctactcgggaggcggttctcattctcaaaaaagtttgtgttaaaaaataaaatgctgcatctaattgcaagtgcttttttaccagtatgtgattggcataacagcaacacatcgaagtgtcaaaagtgtaactctcctgccaagtgaattacctcaatttcctgtaactgctcctgattggttgtatacatctgctgaacagagtcctccaactctgtgttccgatccagtaatgtcttcccaagctcagcagcaagttgaagatctagcacaacaaatgaatcttagaataatacaaatgatctcacatcaacaatttatataacccagtccttcaaaaaagaacatgtagtttaagtcacatcccaatggaaggtggagtggcacagaaggaaacccgagttctacttaaaattcagttaaactgacgcctccagcaggtaatgtattctcttatgtacccatacttgtaagaagtgaaaaatggtcatctactttatggagatgcagttatttgttcaggaatgatcattccgcagtgttacttctaaaatcctatttgctagtacaatgaatgtattcatatcctgacagtctacttttttgaatggacccttgagccaaggtataggtggagctttcaaaaatctttaaagttcccatgaatttgcctgctgtgaatacaactgttaaagtttattgtcatatatcctggactcctaaggggactaaaatttattaagtcaagaaaaggaaaaatacatcagcattaagaacactgccccaggtcactctacttctcttcgtgtccttctgtaagatgagcaactagaaaagcaaaacagaaatgtggtttttgaggtaattacatgtcagtagctcatacttccatttagcacagaaccatattttattttaaacctcatttttcaactctctctattcttaggtataatgcccataaaacaggatttgtttatattatactcaactcccagaaatgaaaatttagttaacaatataagaaaggacactagttgtaacatacgtcattgaaatacttctttgcatagtaaatcttatggagcagtcctttgatacagtgggaaatgcactgcactctgggcaggtaagtctcaggcccagttctatcatttaccagaacactttcaatatggtgactttaaggcccctatagttagtattcttgtttagagagatgactgtcttatcaatataagattgtgaaaatcaaatgaaataatacataaaggagtactttacaaactaagttgcaatacgcacgcaaagtactattaatagtcattgattcacaaatgaatgtttttgttgccaggcactatgctaagcattagctatagaacagtgaataaaatgaagtcctgctttgctgacattcccagattagtggaggaagccagacaaatgagtaactaaactcacatactgtgataaacagtattcatgcatgcatgcatatactcaataatatcagacactattctaggcactgggatggtgcccaggagccataaggaactcacattaaaaaaatatccctgccctcatggagcttatattctactgggagaaacagcacaataaaacttgatagcgataaatgctaaagagaaaaaaataaagcaaggaagaagtacaggaggagtgtggatgtgggaggctgaaatttaagaacatgtgaccagggccacattagaatcaatgtgtgaaggaacagaataagtgacccatgtgtatccatcagggaaacagcactccaggcagaggcaaggcaagtgcaaagcacctgggaggaagcatgactgagtcattaaggaggctgaggagggtggagcagaatgtattgggcagggaggggagggggaagactcaaatcagaggggctccaagatggccagtttgcggagggcctaactaaagaggtcaagagtttggcctttactccaaatgaaggaatccaatggaggtttaacaggatcactccggctgctgttatacagggtgaatgggacaaaggtgggagcagagtgacagaaagatactgcaatcgtctgggtgagagatgatggtggcttggaccagggtggcagagatgaagatgggagaggaggggcagaattctgacatgttttgaaagtaaagctaaaggatttgttgaccaattcaatataaagtctaaaagataaagcgggggagaaaaacctggatttggtgataatgaacaaagggctttctttttctgtctctttattaggcacggtctcgctctgttgccatgctggagtgcagtggtgcactcatggctgactgtagccttggattcctgggctcaagtgatcttcctgcctcagcctgccaaacagctgggactacaggcatgcactaccaaacccagcttacttacttactgatttattgtagagacagggtcttacaatgctgcccaggatgatctcaaacttctggcctcaacacatcctcccacatcagcctcccaaaatgttgggattacaggcatgagccactgtgcccagcctagggcccaatttagaaagggaggtcataaggaaggtctgacaagaccttttagctgaagcttgaaggatgaagaacttgccatgaatttggcatattctacaacctgacaagcagccagtatgatagaagcatgagggatcagatcatataggattttatagcccatggtaggtaaagtttaaattttattctaggtatgatggaaagtagcctcagttattgtcataaaagtattatgaaaaaaatttatcataaaaacaaggaaactcactacataatgatttttaaacttaatttttagaggttgacaaataaggcttaatggctatccaccactactcatagtaaaacttagcattgagtaaatggtaacaacagcattagttgttgtaatgtccactcaagtgcataattagtattctacttggttagttttcactctggaaaaagcagcaaaacctaccacacccaactccagatcatttaaaaacattttacacccatttaaaataaaacagtatactgttggtagataggtgctaaaatacattctcttgtgatttcaaaactaacaatgtctattagtcattacattcattaagactttagaggccaggtgcagtgggtcatgcctataatcccagcattttgggagggtgaaccagatggactgcttgagctcagaagttcgagaccagccagggcaacatggtgaaattacatctctaccaaaaatacagtgaggccctgtctcaaaaataaaaaaataaaaaataaagacttccattaaatctatgaaataacttgtatttacaaaacacagaacttttacaaatagctcaaagcatttaagagacattagtctttttcttgtcattatttatttattttttttgagatggagtctctcactcttgtcacccaggctggagggcagtggtgcgatctcggctcactgcaacctctgcctcctggattcaagtgattctcctgcctcagcctcctgagtagctgggattacaggcacccaccaccacacctggctaatttttgtattgttagtagagatggggtttcactatgctggccaggctggtctcgaaatcctgacctcaagtgatccgcccaccgcggcctccccaagtgctggggattataggcatgagccactgcccccagcctactttttgttttctagagacattagtctttatatctttaaaggtatttagtccagtttctcagatgagacagcctgaagcacaaaactgttaattgacctaatcaagctccaaggtgagtcacagatcaaacagaaactcttaggtcaacaggttctcactctcactctcatcacgattctttgttatcttcatctgcagagttttaaggcaattgaaagagaggtccgcaggcttctttaaggtagagaatacaaatgttccccttgttgaggtacttaatttcttctacttgttttcacagattgcaatgagaaattagagttcaactatttgggtttttattgcctgctctgctagtgaaagcacatacaaccccaggcaagttaataccctgttttcaccaaatgaaaaaggaactatgtatggctcaacatgttccagaaaaaatgattttgtactcacagagtgtgtaatgtgtatacatagacccatatggaagctaccacactgtattaaagacaaagtataaaaacattacctaggtattacttaagtctttccttcttaaatgtgtgaagtggtaattcctcactgggaaggctcagattcaccaaagatgctcttaaccagcaatcaaagcctgagccaaggaccgggtgtggtggctcacacctgtaatctcagcactttgggacgccaaggcaggaggactgtttgaggccaagagttcgagaccagcatgggcaacatagcaagaccttgtctcttagcaggaaaaaaaaaaaaaagaaaaaaaacaaaacccaactgggctgaaacctctcccagaatccagactgtcttgagactatcaccactttcattcagttatggaactacctgtgctacttaagagtagccaggaacctcttccctgctcctgcagaaagagataccaaggacagcactctttagtagatagcaaacaaaaaagaatttgagacttgtccttatctcaaaccttatttccagtaaaacaaagcaccagcctggctcagaaacctgaagtctcgatctcctaaatatttataggctgttaaggatagaattttaacaagtcccaactacaagaaagctcctgtgaagtcacactgtataacaggatattacttcatctgttagcttaaagacaccggactttgtctttaaaaaaagttcatttcctgttgagtagcagctggcttccataaccaaaagaggccaaaagctggcagtaagcccaagaaagttttctaaataattagtggagggaatagaatattgaatgtcccttatagttttaattaaggcacaaaagaaaaggaaataatatagtttcgaagccttatacacctgttcatctctacaggattacaaaatgaattttcattaagagggtcttctctaaatcctattgaactggcctggtttaggcaactactaaaaatactgtagatttattgcaggcttgagaatttcaacatatcaataccttcatatgttgaatattctttcactaatgagtctttgcaggtaataatatatttttaatggtgtaaactgttagctttaaacagatactcagctctatgctttaggcaaaaaattagtactggcagctgtagtctgtaggagtaattcactaacagtaaggctgaaagtttttcctattacaaagtcaaatgcgtcatttagtgatgcttctgtttaactcctgttgccaatgttactataattgggaaagcagaaaacctgaatataaatatcaagaaaaatgatgttgtcagttttaataaccctccaaacagtgattcagcaaaatagttgtacacaaggaggatgtactcatcctgcaattttaggattcctttaaactaagagttcatttactgatccacataacagaaacctgaatccttattctaagtttgcacagctcaccaaatgacaatagcagctggtttaaaagaaaatccagtctctgaagtctttccaccttgttctcaggggcatgtttcaaagcaagcaccatcattacctgcactgaaggctcctgctgtcccagaaaagatcttacccacagagattattgtcagtattcctactgagccaactcagctctctgacaaaagacagtctcttcatcaaagagttttgtaacagcaaagggttttctcctcctgcctacacaaaagctttacatgtttctaacaaggtatgaatagtagaccagagtttactgaggttagaaatttccagcaatttcaatttaaaaacggataccctaggaaactttgatacaaagattcaatctattcagagcatggcttactactgctaaaggaaaacattctatagttgtaagatactgagaacaggatcattaaaagttgttttccagccaggtgcggtggttcacgcctgtaatcccagcactttgggaggccgaggcgggtaaatcacgaggtcaggagattgagaccatcctggctaacatggggaaaccccgtctctactaaaaatacaaaaattagctgggtgtggtggcacgtgtctgtaatcccagctacttgggaggctgaggcaggaaaatggcttgaacgcgggaggcggagattgcagtgagccaagagcgtgccactgcactccagcctggggacagagcgagactccacctcaaaaaaaaaaaaaaagttttaagcagttctctccaaataagccttgctcagtaataataatgaggatgttaaaaaacggacagatgcctgcacataaaatcccactagacttgctgaataatctgtttaacaggacagacctgctcccaaacttaattcagcagcaagtgtctactgagggcctacaatgtacgaggcgctgtagtgggcacatcccatgaggcggcacctccaggcttctctagtgaacagattcctggaacattcactctatgggagtaggaatcctacctatccactcatgtggggaggtgctgtggccccagggcccaggcgaatacctggcaaagagcagataatacatttttgagaaatgaacaagttttaaaatctgttaaaagtttaggagttaacatataacttagcaaaactggggaaaggatacccttttattcacactgtagcctttattctttgacaggccatattcacaagttacaattgttggaatttcacatcttctactcgtactccatatagttggttatgacacagagggttaagtcaaagtccactgtgataacgtaacagccctttgaaaaacacagaaatgcaactggcagtaaagaggttcagatatgtgtgtgtgtgtgtgtgtgtgtgtgtgtgtgtgtgttttgagagggagtttcgttcttgtcatccaggctggagtgcaatagcacgatctcagctcactgcaactccgcctcccagtttcaagcaattctcctgcctcagcctcccgagtagctgggattacaggggcctgccaccacacccacctaattttgtatttttagtggagatggagtttcaccatgttggccaggctggtctcgaattcctggcctcaggttatatgcccgcctcggcctcccaaagtgctaggattacaggcatgagtcactgcgcccagcccagacctgtgtttttaaggttaaacttgaagagctgatgactttattttgatcagaggttaaagagaattcctcgtgtaaccctgacacgttgcacttgctgctcggtagattgaagtgttacagctgttgttcctaacaacctcccacagcgggagaatgcagcgtggactaaggcacctgatggaagagagccatgaaaacaattctgtgcgagtgcttcagtgcagttcaacaaatattaaaatcgagcttccagtatgtgccaagtattatgctagatgctggaaacacaagaaaaaagaacctgccccctctatgcccttaaagattaatgcttcttaaatacaggaaagagaaatatttagttgtgatgatacaaattaaattatagggaagtactgcagtggtacagtggttgcctcacaaatcctggagaaactatcaaactaggccatcaatccttacggggaaatctgaaaacaggtttgttaatatgtataataaatttgtctcttggacataaagaagatggtgccaaacactgcactgcaaccactaagtagcttggactctgtaagtgtaataaaggtgaattactttggttaaagtgattgcatgttaatttaagaaattatcttcctccaaaagaggtgctcattttattttccttttctgagttattcaggtctacattcttttcttctgccatgttcagtggttagcatgaacaagcaacatgatcatttaatattcaactaaatgagatgttaattttcattgcaagattagagctgagagcatttacacagaattgcagaaactgaagatgcctggaaaaattcctgaggattgttcagtactcagtatagcggttaagaacgtttgctctggagtcttaaggagaaccctagcactccccaacattactacctctattgtgttactgggagaattaaatgagcaactgtgttatgggcctatcagtgttaggcacataaaaagtgttccccaactgctagctcctgctattagtataagaaaaacaggggccccactggccccaaagagtgggctactctacgattgttctctggagacaccatcggcaggcctgtttctaagtgaaagctggcgtgcaaactgaagaaaagtggcagagatagatgcgctctttcttctgtcgtttcaattggcatctggtgaactatgcctaacagcttaacgcccaactgaaaaaaactgtaaactaggatggtaaggaagagatggggtttgagcagtgactacaactcttcttctgagtgtgtgggttcaaaaaacactccctcccacacttagctttaggcaagccactttaccgttttaatctccgctttcctcatatggaaaatgggataacaaaagtgtgtaattggattgtttgtacctcaatggataaatgctgggatggacgccccgttctccatcacgtgcttatttcacactgcgtgcctgtatccaaacatctcatgtaccccacaaatatatacacctaccatgtaccctcaaacattaatttttaaaaagttactgtctcctggagttacggtgcggagcgcacagctcccgctacgccgcaaaacaactaccacctgcagcagccggccctccacgctggccatgaaaggcgctgggctagacagcctgcgacggggcggcttctcgggctatgccacttactgcgggacacactggctcacccgggtctgcctcggaggaatgcagtgaggattaaactagctaatccacggaaagcgcttaaaacggtgcctggctcgtccctggcccccacgcgcctcggggctgatattcaactgcgcattagcaaggccgtgggccccgtgccgaggcttcctgcgggcgggatccgcgggcacggccggcccagccgccaggtgagcctgagcccttcccggcacctgcatcctccgccgccacaaaaagcaactttttaacagtttcgcagcgggggcctcccgggccaggccgccgcccgcccgcggggcgcccccgccctcaccttgctggaggtcctggtggtcgtaccacggctcgtcctccttcatctcaaactcctctaccaggttttccgccagcatctcggctgggtcttctaggggcagcggcccccgccgccgtcccgcctcagccgctgccccgggctcttccccggcccctccgccctcagccagagccgccctcgggcgggacgcgccgccgcccagactccgctgcgccgcctcagccccgttcccgccggcggccgccgaccggccggctgcctcgactcgcctcgcgcctaccgacggccccaacggccgggcattacggtgcgaacgcctggagccggagtctcacgcagccgccagtcttcacgccgccgccgggcccaacgtggcactttggcagaaccctccccggccggggatgcgattcaaacccccggcggcgcctcaaccaatcgcgagcgggctgctggccgagcggcagggacttcgtccaatcgcctctctccaaagaccggcggctcgcccggtatcgagggcaagcagccaatggtgggtccggaataaacaaagaaggcggggaaagagtgaaggggtgcggccgaaagcccgtcccctgatctgcgctgtgaggctcctaggagggcgttctgggtttcgggctggggagctggcagaggcgcgtcttacccctgtggtgggtgtcccgaggccggcgcgtctgtggacaggcaacgcaggccggagggcctaggactccggcctctgagaggcgggcggttgtccaggggagtccttcgtgccggcgggaagcgcaagggtgccggaagcctgaggtccgccgcccggccaccccttctcgcatcttgactctgagatttgctccgggtccggcggggagactcgaggtcgatcgggagtttgggttgagaaaacgcccactgagcggtagctcttgtctccttgacatctgagccctgggaattaaactcacgctacataaaacggtgggcaccagacccccttgagaatctggggcggtgagggatgcccgaagctgtccacttggagggcgaaaattgtaagcagtgttgcaacgatttttaaaaggtacccctagaccacaagttaagcatctggggacgtgacattgcacctggaggggacaggctgcagctccagcacttagtagccagcgaggcagagcacgctgtcctccaccgacataacccagcaaatactgctcctaggtaaagctttaagcaccatcttgcagacaaagcacggaaactcttaagcaggatgacagacctgaaggtcaatgttctcaaccttgacgtaaaggtaaaggtgcagctgatggaagacaacagggccaatatctaactaactttgagcaacgaaacaaaaaaaaatcgaggtttaagtatacaattgaaagattatctctagaacatgaggtaataaactgttagaaattcagagagagggaagaggtggagaggagtgttaaatcctgatctattttagaagtgagtcgacagataataccttacattgataatccaatgaatagtttccacaaatatggagagagctgccagaactaaaaatgggaagcaattaagagttttccgaggctggacacggtggctcacgcctgtaatcccagcattttgggaggccgaggcgggcggatcacctgaggtcgagagttcgaggccagcctgaccaacatggagaaaccccatctctactaaaaatacaaaattagctgggcgtggtggcgcatgcctgtaatcccaactacttggaaggctgaggcaggagaattgcttgaaacccgggaggtggaagttgcagtgagccgagattgcgccattgcactccagcctgggcaaaaactgcgtctcaaaaaccaaacaaaaaaaaaaagttttcctaagaggaggagtgatttgaggctggggactttggctttttgttataaacccttctgtgatcttgcttttttagttacttgcacattaaaaataagggaaattgtagggaaggaattatagactcaagctactttttttgtctttctgtataaaaaaagacttgggtaatttggaaggggggaaaaactcatcctgaataattcttgtgggtaataaaattcagggtgtctctctgcctcccatctttgctcaaaccagcataacctaacctcacgctgatgctgtatcaaacagcacttgactccagggttaccttacacataggctgtaggctactctggagaagtcttgccaaggacaagacctcccactgtggagttgttacctgaagttttacccttcagtccttaaaggagactgctgaatagagtggaaagcacaagggacctagagtgagaaaacctagagttctcgccatactcagtaccagcagagaagccttttagcaaacagtttacaggaaagatgattgtttgccttgctcacagagctatctgaatcagagagaccctgaaagcaagtattttgtgctcattttaaatgtaaggctgtgttcttgtgacctatactgtagaagtgcaggtacccttgaggaccaattatgagcatcacaataaataatcatagtaatggattataacccattgaataaaaaggaaagaatccatgagtccatactgacataaataaatgggagagaaaagaaaactttcttacagtaggatgccaagcaaaaaatgtagaaggaataacactgttagaaagtaataataataataaaagaggaatggtaaactcacaaatccctttcttcaaaaaggcaaaatgttactggcacacctgtagtcccagctacttggggggctgaggtgagagaattgcttgagtccaggagtttgaggttacgatgagctatgataggtgacagcagagcaagaccctgtctcaaaaaaaaaaaaaaaaaaaaaaaaaaaaaaggctgtgtacagtggctcatgccgtaatcccagctctttgggaggctgaggcaggcagatcacctgaggttgggagttcaagaccagcctggccaataaggtggcccatctctactaaaaatacaaaaattagccgggagtggtggtgcaagcctgtaatcccagctacatgggaggccaagacacaagaatcctttgaaccttggaggcagaggttgcagtgatccgagaccgtgacactgtactccagcctgggcaatagagtgagactctgtctcaaaaaaaaaaaaaaaaaaagaaagaaagaaaagaaagtgaggtcctgtaaagcctcttctactgccctagttgtccatcgagatattcagagttgaaataagatcacttcaaacaaactatcttaatcactaaagatagaaccctttggaaagatagcaagttggatttaggaataattggcaatggtgatttgtggaagctaaagggctagaatcatgcaggggcattttttttttttttttttttgagagagtctcacgcttgtcacccaggctggagtgcgatggcgtgatcttggctcactgcaacctccgcctcctgggttcaagtgattctcctgcctcagcctcccaagtagctgggattaaaggcgcccaccaccacgcctggctaatttttgaatttttaatagagatggggtttcagcatgttggccaggctggacttgaactcctgacctcaggcaatccaccagcctcagcctcccaaagtgctaggattacaggtgtgagccaccgtgcacggcccccttcacgattcttatcactgattcgcaaggttcaaagtgcccgctgtttgctccatcgaaaacagaagctcattttgacttcaaatgcatattgaaatgttctttaacaattctccattttttttttctttttcagagtctcaccatgtggcccaggctggagtgcagtgacaccatctctgctcactgtcacctccacctccctggttcaagtgattctcgtgcctcagcctcctgagtagctggaattacaggcatgtgccaccatattcggctagtttttgtgtttcaagtagagtcagggtttagccatgttggccaggctgatctcaaactcctggcctcaagtgatccgcctgcctcagcctcccaaagtgctaggattacaggtgtgagccaccgcgcccagtcaacaattctcctttaaaaaagaaaagaaaagaaaagaaagatatggagaattaaagtttttgagggtcaggcgtggtggctcacgcctgtaatctcagcactttgggaggcctaggtgggcagatcacgaggtcaggagtttgagaccagcctggccaacatggtgaaaccacgtctctactaaaaatacaaaaattagctgggcatggtggcgcatgcctggaatcccagctacttgggaggccaaggcaggagaatcacttgaacccgggaggcagaggttgcagtgagccgagatcatgccaccgcactccagcctgggcaacagagtgagacttcctctcaaaaaaaataaataagtgaataaataaagttattgatagtttaaaaaagcaaaaaaacccacaaactttatgtcttttggtgtgttattgggttgtttttaaggacactatttaaggaaacttcttttcccctggaaaatcttgaacaaaaattgcattgaaaaactggtgtcagttttctgtgctaaatttggtgaagtttccattgttcttttagagtctactcagtcatggtttagaagcaatcataagtaacctcttcagtgacgttaatattatttggtttagtaggttagtaaataaccacccaagttgattccaaaaggagaatttatggtgttcataataattcaccattatttaatgaacttgcccagcctaactaaccatggcaccattttgctactatttaattctttttgtttgtttgtttcttcgtttatttttgagacaagatgtcactctgtcacccaggctggagtacagtggcgctatcacagctcactgaagcttcaacctcccagggctcaggtgatcctcctacctcagcctccctagtagctgggactacaggcatgtgcgaccacatctggctaatttttgtattctctgttgagacaggttttcaccatgttgcccaggttggtcttgaactcctgggctcaaacaatctgcctgtcttggcctcccaaaatgctgggattgcaggcctgagtcaccatgcctggccaactttataagttttctttataaaatatgttgtgataaataagatcagattcagaaatcctttgtcttcggttgtaaagataaaatgctcttgttctcttttgttttattgctatagtaaagtcatgtaaggagagtttttaggtagcaatgggggctttaaaaaaattgtaagtggtgattttcagtttgatacttacagaaataagtatttactatgataacagtaatctatttttaaggaaaatttgtattattttaattatttttatgtacagaaaacttaacagtgtacatttaacccagtttagtggcaagttctttagcctttgccctttcgagcttggcgatacgagccacagacttaggacccaggacgttgccgccccagtgacggtggatctcatagtatctgccattgtaattgggatgacagtaatctaaaggaaaatattaatggctccttttgcagaaggaaataaagatttctacttcacgcaatatgtaaaaacaaagagaagttcagaatgtagacttttttaaatttttaatgttttaaatttttttttttttttttgaaacagtgtctctgttgcccaggctagagcgcagtggcatgatcttggctcattgcaacctccacctctcagtttcaagcattctcctgcctcagcctcctgagtagctgggattaccggcacctgccaccacacccggctaatttttgtatttttagtagagatggggttccaccatgttggccaggctggtctcaaactcttgacctcaagtgatctgcccacctcggcctcccaaagtgctgggattacaggcgtgagccactgtgcctggccacgaagttcagaccgtagagtttttcataatgcaattgaaaccttatattcttatgtttcggacaggctgggtacttaacttaaatctttgaaaaaaaaattgaattcaactctcagaaagcttatggccttttgcagaattataagtttacaaatacctgccatgcaacttagtgatagatcagattagaaaggtgcagcatgcttcttgttttagcacgcctgaaataaaactaaaagaaacaagagtccctaggttttggtaggctaaatttgtgtcttggcttttgattctactgtctcccttgtttttgactcttttagtaaccaagcaacctctagcctcagtcttcattctcagggatgaactccttagagtgaagtcttcactggtagttcccagcattttgaaatctgagaattgcttttaaagtaaaaaatgttggctggcctccacacaatagtagttttgaagtgtttgggaactgcatcatgatgaaaacaatcagatttgtatttttaatcattatagcagaagctacaaacattttaagaatacaagtacacatgtggacaaaacattctttattctatagacaatgcttggtatgcatatgggtttgataacccatttttgataattctaggaccctgccactcatagaattagagtcttcttttttttttttttttaatttgagacagggtcttgttctgttgcccaggctaaagcgcagtggcgagatcatagctcattgcagcctcaaactcctgggctcaaccaatccacccgcctcagcctcctgaatagctaggactactgatctgcaccaccacacgtagctgaattataatcattcttgggtctacttggtgcaaagtgaagtgtagagaccttaaataatttggtcatttgagccaaatgccaacttcctccttctgacttgccctctttttccctaagaaatttggcagtgtagaccgaactgtctgcttaattctgttcctggatctacaaagttaaagcgaggcccaaggattactcaagcaagtaacatcctttgagttatctgaatctgtgtctgttttctgactgaataagatgcagagacctggctaaatattcaagtaagccaagaatagaacagaaagatcatggtattctctttaaactatagtcaagattgaaaggaagatgaatctatgccttcctcttgcttggttagccttttcctgttttctacttataaaaatcaaagggtaagacagacaataggctagatttaagataggcccatacaaggatctcagcaaggatcagaatgtgttatttctgtacccattgtagtgatgtccttgctgtcaaagctacagaagatcaagaataagtcttcaaatgcaagtctgtactactgaatgaacaactttaaactaagatgagggacttattttctttttgacttgagcaaaaggctgtcaccttgttgttctgtttctgttgtaccctaccaagtaaggaggataataatggcataaacatatctccttgacactagttaatcatgtccaagctcttggatgaatcccactttattttatatatttttttgaggtggagtcttgctctgtcgcccaggctggactgtagtagtgccatctcagttcactgcaacctctgcttctggcgttcaagcaattctcctgcctcagcctcccaagtagctgggactacaggtgcatgccaccacacccaggtaatttttgtatttttgtggagatgaggttttgccctgttggccaggctgaaatcccactttataagttcgaagagatagacaaaaatataagtggagtcatactctatgcaaactaggtttcctggcgagcatctcaaaaaatattgagtgaatagataaggaagtaaggtgttaaatctggtgacatactcacagctcgtaggtttgaactcttatttggctaaaataagtactggccagccatgttttgcccccccatccactactgtgtgcagtgaattttaacctttttttttttttttaaacaaagggaagaagagttcctctgcatggaaaatgacacttttaaatatcaaacccattgcttgggcatactctatgatgacattagggactgaaatgctgaattctgtctttggtttctactatgtgaaactttttctacatctgtacaagatttcagaagtggccttttatcaagcccaggtgagatggaatctttactgtcctttcacataggacagatctccttcctttgagggaaagagagatttttattttttattttactttattttcttttatttattttttttgagacggagtctcactctgttgcccaggctggagtgcagtggcacgatctcggctcactgcaagctccgcctcctgggttcacgccatccttctgcctcagcctctcgagtagctgggactacaggcacccgccaccacacccggctaattttttgtattttttagtacagacagggtttcactgtgttagccaggatagtctcaatctcctgacctcgtgatccacccgcctcggcctcccaaagtgctgggattacaggcgtgagccaccgcgcctggccttttattttattttttgagacagagttttgctctgtcacccaggctggagtgcagtgcacaatctcggttcactgcaacctccacctccccaattcaagtgattcgcctgcctcggcctccccaatagctgcgattacaggcccatgccactacgcccggcgaattgttgtatttttaatagagacagggttttgccatgttggccaggctggtctcaaacccatgacttcaggtgatctacccactttggcctcccaaagtgctgggattacaggtgtgagccatcgcgcccagccggaaagagagatttttaaaagattgctagttaaaatgtaaaggcattagaatttaaagaataagcttaggttgtctggaaaattaatttatatggaaaaatcagtattattactaagatatccagtctctgtccctctcttttttttttttttttttctgagactgctctgttgcccaggctggtatgcagtggtgcaatcatagctcactgcaggcttgacctccctaggatcaagcaatcctcctggctcagcttcctgagtaggatgacaggtgtgagccaccacacctggctatttttttttttttttttttttagaaataggggtctcactatgttgtccaggctggtctcgaactcctgggctcaagcaatcctcctgcctcagcctcccaaactgttgggattacaggcatgagccactgtgcccagtcctaaaatattctgttttgaaaaggcccacagtattcacaaattgtgttgtaactcattaccaattaggtggcaggctggaagagttcatggttttaaaacccttatattttataatgttactcatttattaccagtaataacatactaattagatttaatttgaaatgccaaacattgatattttaacctttcctaatgaaattatgtaaaactatgccttggtgtaaacaggccatcaacctttgcagaggcatggccctgtgtgctgttgttggaaggcagtctagcacaagattgaaagcacatgctatggggtcgtctaccttgggttagaccctggctctgttgtttattagctaggcaagttgcttaacttctctggctctcagttttctcatttgtaaagtcagagtaatacttgcctcaaaggattgttttttgtttgtgtgtttgtttgtgatgggagtcttgctctgtcacccagactgcagtgcagcggtatgatcacggttcactgcacctcgacctcctaggctcaagcagtcctcttacctcagtctccaagtagctgggactacaggtgcacaccaccatgcccagctaattaaataaaaaaaattttttggccgggcgtggtgcctcacgcctgtaatcccagaactttgggaggctgaggtgggtggatcacctgaggtcaggatttggagaccagcctggccaacatggtgaaaccccgtctctactctaatacaaaaattagccaggcgtggtggcatgcgcttgtaatcccagctacccaggaggctgaggcaggagaatcactggaactctggaggcagaggccgcagtgagccaagattgctccactgcactccagcctgggcaacagagcaagactctgtctcaaaaaaagagaattttttttttttaattttagagatagggtctcgctatgttgcccagcctggtcttgaactcctgggctcaagcaattctcctgccttggcctcccaaagtgctgggattacagacatgagccactgtgctcggctagggtttttaaggatttgataaaataatgcacataaacacttatacaatgcctgaatacaaagtgaatgcaagccgggcgcagtggcttatgcctgtaatcccagcactttgggaggccgaagccggcagatcacgaggtcaagagatcaagatcatcctggccaacatggtgaaaccccgtctctactaaaaatacaaaaattatttgggcgtggtggtgcgtgcctgtagtcccagctacttgggaggctgaggcaggagaatcacttgaacccgggaggtggaggttgcagtgagccgagatcgtgccgctgcactctgggctggcgacagagcaagactccgtctaaaaaaaaaaaaaaaaaaaaaacaaagtgaatgcacattggcttttgagtagtatttgctgttattaaatttttaagtagttctgaaaacaatgagcttttctactgatcaccttcggttacttcacgtaagtaaaaaaaaaaaaatcaggggtcatttttgtcttgtactgagggcagtaatttgttctactacactgaaacatcctgtgtgtttttttcttcctaaataattttaatgatatggaatgttcttaatgacctgactggatattttcccaacaactctaaagccaaatgctgttcaagtcatcatatttctgtcttgtactgtgtccctttctatgcagcagccttcctgctcccgtggttcccttggaaatactatcaagaaggtgactggcttagtggacttcacctggtggtatcattatgtgcatttgatagcatgcccacctgtgtccaacaagcccaatgtaaactgtttgcagagattttcactagacatgaaagtcggcttcagcttattaaaattaaccaagtggcatcacttgtgggctctaccagtatccttttctatggcctgatctctaataacatggaaattttgccccatttccaggctgttgccatcgtcattgctttccttgctgctgccagcctttacgctgggatgtatcacgtgaggcgtttcaaacctaaaagaagccccaaagagaacctcctcttggaatctaaacagaatctcgcctggactcctgtcattttatccgtgagatagatcttgccccagaaatacttttacctttttctgatcatgaatttctttcaagtctttaatttaacctttttcagcaacttcatgatgatctttgcagatattctcattcccagagatgtactatcttcttctataaggagcattatgtacggggcaggctttatttgcccacaggtatgtaatagttctttatgttatttactattattataattattatacttatgttctctatgatttataatttgtgataatttttcctgcagggattagagatttaactcttagctggatgatgatattagaaacctgatttcatcagtagtttgaaaaagtgacacacagtttttttttgtttgtttgtttgagacagtcttgctctgtcacccaagatggagtgcagtggtgtgatctcggctcactgcaaccctcgccctcccaggttcaagcaattctcctgcctcagcctcctgagtagctgggattataggtgcacgacaccacacctggctaacttttgtatttttggtagagacggggtttcaccatgttgttcaggctggtctcaaactcctgacctcgtgatcagcctgcctcggcctcccagagtgctgggatttcaggcatgagccaccgcacctggccgacacacagttattaaaagacccatagattcagagctccacatatcatacaagattcagtagaaacataatggaaaaaagagacaaggtcaagcccactggcccatgcctataatcccagcactttgggaggccgaggcgggtggatcactagaggtcaggagttcgagaccagcctggccaacatggtgaaaccttgtctctactaaaaatacaaaaattagccgggcttggttgcgggcacctgtaatcccagctactcaggaggctgaggcaggataatcgcttgaacccaggaggcggaggttgcagtgagctgagatcgcaccaccgtactccagcctgggtgacagagtaagactccatctcaaaaaaaaaaaaaaaaaaaagagacaaaaggaaaaaaggaaagagtccccaatgagaaccgaataatgtgatattttaaacatttttgctgtggaattttgttcctctcagctttctcctttaagcctcagcagaactatggaagaaaacagcttcctgtgagcgtgtcgttttgctttatttgggtgtttaagacttctgtgaccatcacatggaagaacagttagttgatcaagtttcaaaacacttggctaaaagcctgagtcctggaatttcagagcactattaaaattccatggtcatgatcattattgtagaggtcatgtcctcttaaaaaaatatactggtctgctgcttataccatttggagagctgatatgttgttccccttaacctaaatatgtcctctaaaaatatgactttatcttgcctatgataaaggtttttcctgttttcacaaatgataagcaaaacatcttagcaatactcttcagggaagaggttattctagatagactagtttttactgtttaccagctttcaaaaatcgttaagccatttgggatagaaatagttctaaaatgttttaagtgttgccacaatttctttatttctatttatttatttatttatttatttagagatgaagtctcgctctgtcgcccaggctggagtgcagtggcgcaatctcggctcactgcaagttccgccccccgggttcatgccattctcctgcctcagcctcccgagtagctgggactacaggcgcccgccaccacgcccagctaatttctttgtatttttagtagagatggggtttcactgtgtttgccaggatggtctcaacctcctgacctcgtgatctgcccagcttggcctcccaaagtgctacgattacaggtgtgagccaccacgcccggcctatctctttatttttttagagacagtgtcatgccctgtcacccaggctggcgtgcagtggcacaatcatggctcactgcagccttgatctcctgggctcaagctttcctcctacctctgcctcctgagtagctgggatcacaggcgtgcaccaccatgcccagctaagttttttattttttgtagagacagtgtttttcaagaccagccatgttgcccaggttggtcttgaactcctggtgtcaagcagtcctcccaccttggcttcccaaagtgttgggattgcaggcatgagccacagtgtccggcccaccacaatttcttaagcaaagtatatagaatagaatttgcctgtctgctattatcccaatgtctttataattactgtatgtgccataataatggtaatccacagttttgagtgtttaccctgtgccatggaccattgccaagtgcattgtgtacattacctgacgtgatcctcataacaatcttggaggaagagattcttattcttacagacgagaaaagggagatggtacctttagagctgtgtactttaagattctgtctctaaaatgtactgtgcttgcatcatttatttagcagagtatatcaaatggaatttcatgtctggcttatcagtatagtccatgtactgtgtatgcatgataaaatgatgctctcctttcaaagcaatttgaagtttgtttgctcctctgtttaaccacccagaatgggaagctgtttgagttcctgtctctgcttattatttgctatcatattctaggctatatatgctttcttactttaaatcatgtataatacttgcctatagtttatcctcttcaccaggttaaaaaaaaaattgttaaactcttatgtaagcctgggtgtggtggctcatgcctgtaatcctggctttttgggaggacgaggcaggcagattgcttaagcccaggagttcaagactggtctgggcaacatggcgaaaccctgtctctacaaaatatacaaaaattagccagacatactggtgtgctcctgtagtcccagctattcaggaggctgaggtaggaggatcacctgagcctggggaggacaaggctgcagtgagccgaaatcacacttatacactccagcacgggcaacagagtgagaccctgtttgtctcaaaaccaacaaacaaaaactctcgtgtaaagacaaagagtaggctgggcgcagtggctcacgcctttaatcccagcactttgggaggccgaggcgggcggatcacgaggtcaggagattgagaccatcctggctaacacggtgaaaccccgtctctactaaaaatacaaaaaattagccgagcatggtggcgggcgcctgtagtcccagctactctggaggctgaggcaggagaatggcatgaacctgggaggcggagcttgcagtgagccgagatcgtaccactgcactccagcctgggcggcagaccagcctgggtggcagagtgagatctctgtctcaaaaaaaaaaaaaaaaaaaagtagattttttttctcttaactcagctcaagaacaaccagcaaaggtagattttttaaaaacagttttgttgaaatgattcacataccatacctcatttaaaacatacaattcaacaaattttaatatattcatggagttgagcaaccagcactacaatcatttttagaacatttttatcattttgaaaagaactagtcaatttttgaggagttgaaattcttgaaagtacaatctcattgcactttcccctcatcccttggttaccatcagtctacattttgtctctatggatttgcttgttctagactttcatataaattgaatcatataatatgtggtcttttgtgaccagcttccttcacttagcattttttttacactagatgtaatttgatgtacacttagcatgtttttaagattgtagtatgagtacttcattccttttaataacttaataagtcatcatatggctataacacattttgtttatccactcctcagttgatgagcatttgggttgtttctgctttttgactattaacaagtaatgctgccatgaacattaatgtacaggatttttgcacagatatatattttcatttcttttgggcatatatccaggagcggaatagttgtgtctcacatagtaactctatgtttcacattttgcgatactgacagaccattttccacaattggtgcactattttacattcctaccaataatgtacaacgggtccagtttttccaaatcctcaccaatacttgttattatctgtgtttttgattatagccatcctagtgtgtgtgaatgacatctcattgtagttttgatttgcatttgcctgatagttaatgatgttgtgcatctttttatatgctgttggtcatttgtatatgttctttagagaaatgtctattcaggccaggcgcggtggctcaagcctgtaatcccagcactttaggagactgaggcgggtggatcactggaggtcaggagttcaagaccagcctggccaacatggcgaaaccccatctctactaaaaaatacaaaaattagctgggcgtggtggtgggctcctgtaatcccagctactcgggtggctgaggcagggagaattccttgaaccctggaggtggaagttgcagtgagccgagatcatgccactgcactccagcctgggtgacagagtaagactgtctcaaaagaaagaaagaaataaagtaaaagagagaaatgtctattcagcccatttgcccagtttttaataattaggttgtctttttatttagtttactaatactcgagttgtaatagttcttcatattaatatatgtttgatgcaatctgttatcagatattgtttgcaaaatttttctcctgtgggttgtcttttcactttctttcttgatgagattgagaagtatgagtcttcctactttattcttctttttcttttttatttaatttaattttttttgaaacaagagtttcagtctgttgcccaggatggagttcagtgtcgccttgacctacactgctcactgtagcctcgacatcctcagctgaaccaatcctcccacctcagcctcctgagtagctgggactacaggcatgcgccaccactcccagctaatttttaaaaattattttttgtagagatggggcatcactatgttgcccaggttgacctcaaactcctggtctcaagtgatcctcctgtcttggcctcccaaagtggtaggattatagtcgtgaaccactgcacccagcctcgttcttctttttcaagattgacttggctattctgagtctcttgcaaatctatatacattttagaatcagtttgtcaatttctacaaataagtcagctggaatactgatagggattgcactgaatttgtagatcagcttgagtagtattgccatattaatgatgttaaatcttctgatccatgaacatgggatgtttttccatctatttagatgtttagaaatttctttcaatattttataattttccccttcttttgttaaatttattcacaagtatttatttgtttatttattattgatttattgagatggagtctcactctgtctcccaggctggagtgcagtggcgtgatctcggctcacagcaacctccgcctcccaggttcaagcgattctcctacctcagcctcccgagtagctgggactacaggcatgcaccaccaagcccagctaatttttgtatttttagtagatatggggtttcaccatgttggccaggctggtcttgaactcttgacctcaagtgatccacccgcctcggcctccctaagtgctgagattacaggtgtgagccaccatgcctggccttttttttttttttttaatcttttagagacaaggtctcactctgtcccccaggctagagtgtagtggcatgatcatagctcactgcagcctcaaactcctgggctcaaggaatcctcccacctcaggttactgagtagctaggattacaggcatacaccaccatgcctggctgacttaatttcttggtaaagatggagtctcgctatattgctcaggctggttttgaactcctggtctcaagcaatcttcctgcctcagcctcccaaagtgctgggattacaggtatgagccactgtgcctggtcattaacaggttttaatataagcttctgtttttgtttttcatgctttatttaatatttggaaaaatttaagagttgaaagaaaggcaggatttttcttgtagctttattgcagtatgattgacctacaaaaaaaactgcatgtatttaaactgtatagtttgatacattccagcatatgtacacaccatgaaaccatcaccacaattaagatggttaacgtatctattattccccaaagtgcctttctgcttctttgttaatcccttccttccacccttccctaacctccctaattctcaggcaactgtcgagctactttctatcagtatagatttgtttacattttataggtttttatataagtggaatcatacagtaatgtactattttttggtctggattcttttggtcatgttgtgagtatccatatttaattcctttttattgccaagtagtattctattatgtgggtataccacaatttgcttttttttttttttttaaataattcctccccctccgcccacgttttttatcatttcaacttttattttagattcagggaatatatgtgcaggtttgttatgtgggcgcattgtgtgatgttgaggtttggggtatgattgatcctgtcactcaggtagtgaacatagcacccaatagttagttttttaacccttgccccctgcctttctagtattccccagtgtctattgttgccatctttttgccatgagtacccaatgcttatctcccacttataagagagaacatgtggtattagcttgtctgttcctgtgttaatttgctttggataatggcctccagctgcatccatgttgctgcaaaggacatgatttcattctttttatggctatgtgatagtccatggtgtatatgtgccacattttgtttacccagtccaccgttggtgggcacctaggctgattccatgtcttcactattgtaaatagtgctacaatgaacaggagagtgtatgtgtctttttggtagagcaatttatttccttttggatataaacccagtaatgggattgctgggtcaagtggtagttctgtgttaggtagtttgagaaatctccaaactgctttccacagtggttgaactaatttacattgccatcaacagcgtataagtgttcccttttctctgcagtctatctgtctgttggtttttttttttttacttttagcaatagccattctgattagtgtgagatggtatctcattgtggttttgatttgcagttctctgatgattagtgatgttgagcattttttcatgattggctgcttatgtctttttttgagatgtatctgttcatgtcttttgcccactttttaatgcagttgtttgtttattgcttggtcaattgcttaggttccttatagattctggatattagacctttgtcaggtgcatagtttgcaagtattttctcccattctataggttgtctgcctactctgttgataatttcttttgctgtgcataagctctttggtttaattaggtcccacttgtcaatttttgtttttgttgcaattgcttctaaggatttagcaataaattatttcccaaggttgatgtccagaatggtgtttcctaggttttcttttaggattcttatagtttgaagtcttacattcaaatctttaatccatcttgagttaatttttatatgtggtgaaaggtgcagtttcagtcttctgcatatggctagccagctatcccagcaccatttattgaataaggaatcctttccccattgcttatttttgttgattttattgaagatcagatggctgcaagagtacagctttatttctcagttctctgttctgttccattggtctatgtggctgtttttgtaccagtaccatgctgttttggttactgtagccttatagtacgatttgaagtcaggtaatgtcactggctttgttctctttgcttaggcttgctttgctatttgggctctttttggttccatatgaaattgcaaatagtttattctaactctgtgaaaaatgatgttggtagtttgataggaatagcattgaatctgtagattgctgtgggcagtatggacattgtaacaatattgattcttccaatccatgagcatggaatgtttttccatttgtgtcatatatgatttttttcagcagtgttttatagttctccttgtagagatctttcacctccttggtgagatgaattcctaggtatgttaattttttctgtggctactgtaaataggatcgcattcttgatttggttctcagcttgaacattattcatgtaaagaaatgccacagatttttgtacattgattttgtatcctgaaactttactgaagtcatttatcagttccaggagtcctttggtggagtctttagggttttctatgtatagaatcatattgtcaccaaagacagatagtttgacttcttctcttcctatttggatgtaatttctttctttcttttgcttgattgctctggccaggacttccttctttcatctcttgatggacatttgggttggatctggtttttggctgttacaaataaagctatgagcattttgtgtctttgtatggatatatgctttccttgctcttgagtaaatacctaggagtagaatggctgggttgtatggaaggtagatgtttacctttctctttactttttttttcctttttttgtttgagacagagtctcattctgtcgcccaggctggagtgcaatggcgcaatctcggctcactgcaagctccgcctcctgggttcatgccattctcctgcctcagcctctcgagtagctgagactacaggctcccgccaccacgcctggctaattttttgtatttttattagagatggggtttcaccatgttagccaggatggtctcgatctcctgacctcgtgatccgcctgcctcggcctcccaaagtgctgggattacaggcgtgagccaccacgcctggccggtatgtagtatcttactgtgtttttgatttacattttcctaatgactactaatgatgttgagcatcttttcatatgcttacttgccatccatgtatctttttggttatttattaaaataatttgtgtctttttaaattgagtaattagtcttcatattattgagttgtaggagttatttgtatattctaggcacatgtcttttgtcagatatatgatcagtaaatactttctcttagtctctcttggttactagttgttaagagaagtatagccaaaagattttaacagtcatttttcttaagccctcacaaaaacataggactttctattgatctcaataaaaaattattataaaatggaaatccaggtctggcccaatggctaacacctgtaattccagcactttgggaggctgaggcaggaggattgcttgaagccaggagtttgggaccagcctgggcaacacagcgaaaccctgtctctacaaaaaataaaagaaaatccaaagttgcttgaaatttattcttaatttctagagaattaacacgtgtaaattattgtggtaaaaaatgacagcttggccaggcgtggtggctcacgcctgtaatcccagcactttgggaggctgaggtgggtggatcatgaggtcaggagttcaagaccagcctgccaagatggtgaaacactgtctctactaaaaatacaaaaaattagccgggcgtggtggtgggtgtcagtaatcccagctagttgggaggctgaggcagagaattacttgaacctgggaggtggaggttgcagttagccgagacggtgccactgcactccagcctgggtgacagactctgcctcagacaaaaaaaaaaaataatgacagctcattggaatctgttgttcttgttattcatttggctaagtctctttaacactttattggataaaataatgaagggtgagcactatgttttcattttctctttctctctccgtcctccctccctccctttctcccttcctctttctttctttctttcttctttctttctttctttcttctttctttctttccttttctttctttcttaccttttctttccttttctttctttcttttctttctctctctctctttttcttgagacagtctctctctctctctctctctctctttttcttgagacagtctcgctctgccacccaggctggagtgtgatggcatggtctcagctcactgcaatctccgcctcccagattcaagcaattctcctgcctcaacctcccaagtagctgggattacgggcatgtgccaccatgcctggctaatttttgtatttttagtagaaatggggtttcaccatgttggccaggctcgtctcccaactactgacctcaagtgatccacctgcctcggccttccaaagtgctgggattacaggcgtgagccaccgcacccagccctcaggctggttttctttttgaggagttgaataaataaaggagaaaaggatgaataaatactctgtctccctaataactgttggtataggtctgtcactcttccatattacactccccagagaggcagaggagtaactgggttaagagcatggatctgcagtctgcccaggaggagcctggctctccacttactagctgtgcaatcctaggtaagttactcaacctctctgtgccttagtttcctcatctgtaaaatgaggatcaaaatagtacctactggtctgggcacaatggctcccagtactttgggaggctaaggtgggagggtcacttgagcccaggagtttaagaccaccctgggcaacatagcgagaccctgtctctataaaaaatttaaaaaaatagccagacatagtggcacacacctggagtcccagctacttgggaggctgaggtgggaaaatcgcttgagcccaggaggtcaaagctgcagggagccgtgattgtgccactgcactccagcctgggtgacagagcaagaccctgtcttaaaaaacaacaaaaaaatagtgcctacctaaggaaattattatgagggttaaatgaattaaaacatccaaagtacttaaaacggttcctggcacaaaataaaccctctagaaatgttagctcttattatgtacagccaactcagtgcagcaggtatctattagactttcactgtgagcacagcactgcctttatccctctgtcttgatgtaggctcctttgccacaggtttgccaacacttatgttggaacacactgttgaatggggagccaaaatctttcatctgtagaaggctttattttagttaaaaaaaaaaaaaaaggcggtctttctcttttctttcatgatttttgtgatactactcatcattggcttatatctttttatatattggacacaagaaaaatagctaccaattattaagtgccttatatgttgagtatggtgctaggtaagagaagagaaatggaagagagcaagagtgagagagagagagagagagagagagagaaagtttgtcttggtgggggaaatgcctcttaggtaaagtaacttgtctgtgaagaaatagctggtaaaagtggcaaagctggaatttaaacctagggacatctgatttcaaaatctttcactttttagccagacgtggtggtgcatgcctgtggtcagctacttgggatgattgcttgagcccagaaatttgagaccaggctgggcagcatagtaagaccttgtctgtaaaaaaaatcttgcacattccactctaccacatatttcttacattattaacttcttgtattttgtatgtttatgtactagagatggagaaacagcagctgcatttcaatatgtggaaatgtgttcctttataatattataataatatttaagaatataattggacttgttggggtattttatatacttcctcttacagaactctaagaaatgccttggaccacatcaatcactgatccattgttttttagtatccagaaaatgaactcttgttccttgaaagtagaaaagtcagtcaaaaaatcagtcagggtaaaaaaaacccttatgtttattaaagaacatctgtattctacttacatcattcaaaattctcttctaactataatgcacatacttttggttagtgaaaacttatcagggataaacaatgtgtgcttttttattgaaaacaaagagtatcttctgatctttgttaatgtacatatgtatatttagcataaacttttcagtctagaacaatgaactttttcactgatagcaagaaatgcaaaaaacctaagtctgagctcttaaaatgaatctgttataatgataaaaacatataaagttaggcagggcacagttagcaaggaatgctaactcttgtttaccctgatgcttgattttagggtaaaaagtacatttcaggcaagatgtggtggctcacgcctgtaatcctaacattttgggaggccgaggcagacagatcacttgagcccgagtttgagaccagcctggccaacatggtgaaacactgtctctactaaaaatacaaaagttagccaggcacagtggtgcttgcctgtcatcccagctattcaggatgctgaggcatgagaattgcttgaacctgggaggcaaagtttgcagtaagctaagatcatgccactgcacttcaacctggatgacagatttgagactctgtctcaaaaaaaaaaaaaagttaccattcataatcaatttttggtatatatggataataatggcatatctaagcaagatagttttaattgtgtgtttcaattgacactataattcagaagcaaatttatttatttattacatattttttgagacagggtcttgctctgtcactcaggttggggtgcagtgggtgtgatcatagatcattatagcctcaacctcctgggctgaagcagtactccaacctgagcctccctagtagctgggactacagctgtacatcaccacacctagctaatttttgtattatttgtagagatagaatttcaccatgttgcccaggatggtcatgaactcctgggctcaagtgatccttctaccttggccttccaaagtgttgggattataggcatcagccaccacacctggccagcaatttattttgcaataagaatgtttattttgtcatcagcaagagtaagtaagcttaataatgcgtggagttccatcttaacacaatgccattctgtttccatttcagtgccttgtacttatcagtcagtcctggctgaaaaagtttgattaccataagatcatcttaatttctttctatgtagaaggaacagcctccattgtaatgttactcctgggaaagcaatactattactgtttggctctttatctcactattatcatgtaagtaaatgctggttccagtctcaaaattacactaaattttactatttgccctttcaagcagtgacacatttttgatccggactgagtttaatattcatttctaggcaaggtcattgtacctttttgacaaattgtctgaatgttaatggcttgttttatgaaggaatttcatacattaaattttgtagtaaacttacttttttttaacctattaaaaaatttacttggaaggctaaggttggaggattgcttaaggccaagagtttgagactagcctgggcaacagagtaagaccgcatctctataaaaaattaaaaaattttttggtggcacatgcctgtagtcccagctactctagtggctgaggcaggaggatcatacttgagcccacgaattcaagtcatagtgagctacgactgcaccactgcactccatccagcctaggtgacaagagtgagaccctgtctcaaaaatatatttagtaaatactgctgccacgtataaaagacactgagcttctatttctccttcaactcttcctcctatttctgcaacctctcctcctcccccaagcacccactttgcctccatcacaggcatgtcaaattctgcaggtccaaatcaaagatcttgctgccaaatctgctcttttgccattatttgccatctcgggaaatggctttgccatctatctggttgcccaagtcagagaccgagaagttgtctttgccttttctctcttctttgacacctaggtccaacacactgttaattgttagcagttttatctccctaatgtgccctgaatccatctcttctcagttccactgacattcctatagctcatttcttacatggaataggatacagtcttcccatatgatcccctagtttatagtctccagtctctccaactccctctctcatattgcttctagaataacatgctcttcctttgcttaataatcttttttttttttttgagatggaatctcactgtgtcgcccaggctggagtgcagtggcacgatcttggctcactgcaagctccgcctcccgggttcacacgattctcctacctcagcctcccaagtacctttaataatcttaagtggcttcttattgctttcagggtatttcgaaatgatgacattatgatgtcttgttatatagtccctctttatcttttcgtcttcatttctttttttttttttttctgagacagggtcttgctctgttgcccaggctagagtacagtggcacaaatatggcccactctaacctccacctcccaggctcaggtgatcctcccacctcatcctcctaaatagctgggactacagatgtgtactaccatgcccagcttaatttttattttttgtagagatgggtttttgccatgttgcccaggctggtgttgaactcctgggctcaagcgatctgctcaccttggcatcccaaagtgctgggattacaggtgtgagccactgtgcccagccttcatcttcatttcttgttactcctcaacttacactgtactctctgccatacagaaatactttgcagttcctggttcagacacctctgtgtctagaagatgcagtttcctgtgcctggaaagctcttccccatttcttgcttggccctgtcctcacgtgtcttaggccacagttcgggcatgtgcttctctgggaagccttccctgatttcctcatctggattaggtggccctcctatatgactccagtgccctatgcttacttctgctgtggtgcttttcctctacctgcgactatctgtagtccccactggattgagtttattgtgaatagggtctagtctcttaccactgcggcccattacctactgcagttcctgcaaatagttggtccttagaaaatgtgttttgggccaggcacagtggctcatgcctatacttccagcactttgggaggctgaggtgggaggatcacttgagcccaggagttcaagaccagcctgggaaacatggcaaaaccctgtctctacacaaaataaaaatttagccaggtgtggtggtgcactcctgtagtctcagatattcaggaggctgaagtgggaggatcacctgagcccaagaggtggaggctgcagtgagctgaaatcatgctactgcactccagcctggacaacagagtgagtccctgtctcaaaaaagaaaagaaaagaaaagataatgtttttgtttttgttttttgttttatttgagatggagtctcactctgttgtccaggagtgcagtggcgtgatctcggctcactgcaacctccacctcccaggttcaagcaattctcctgcctcagcctcccgagtagctgggactacaggcaccagccaccatgcctggctaatttttgtatttttagtagagacggggtttcaccatgttggccaggctggtcttaaactcctgacttcaagtgatccacccacctcgtcctcccaaagtgtaggattacaggcatgagtcactcattttgagtgaatgaattaatacattctattccaggtccctgctggaacaacttgagaaaattttcatgaagacatatttgcattttgaacaaactggtagtggagactgtaataattgactcaaatgattgaatccctatgaaacttcaagacattagaaccccatgcagataactattctataagtctgtaagggtggccctggctgtataatatgtaaaatgatagtttatagtaatttttagaatgaatatttttgctttttcttcacttaaaccatccccctcatttttattcttctatcataattaaaatgctatatgccctttctcagttcttaatgtatcctatttctgatatcaagagaaagatgtctgtgtgattaatttccctggcacttcctgtcctttagaatctattaataatttaagcagattaaatgagtttagtcatttggaatgaggaagaagcataaaaatcatttttaaaattcccaagtgaaagtagttatttcacttttaaaagagaattatatattcatagatatataatatttgggaggatagaagggtatgcctaatatagctttacttttatagtatatcatttccttttatcttcttgcaaatcaaatgtcaactttcattttattcttttttaacaaaagctgtgcctcctagttgtaaaattttcatatgtgttttaacattttttctagggttatcgtgtgagcttcggtttccttgtttaccctgccactagctgacatggttgatgcagatttactaaagtttaatcagcagtaagtatactttttcaaatgttagctacaaaaatatcacatgtaggcaggacctatcagagtctccatatctcagttatattgccactacaaatcacatatctgaaagacaatcataagaggcattgctaggaaccaggggacagaatataatcagatatattcatgcttgtttgccctgggcaacttttccccatttctaaaacgacatcacagtttttcatttctcaggttcacacagccaatattacaacagggttaaatatcagaaagcaaagtgaaatctcagttagctgtatgttctacatatggcaatatgctttattacatgggacgattaggtaaaatgacctttactctgtgacattgcaagaattaaaattaaaaatcaaggtccatcttatcctttcttagctgaaaaagcctaagctgatgatgagaggttctgttctttggtatgattgtaagcactttagatcagctataaagtgtatttgattggcaaatattttctcatacgtgtcctattttgcagattagagagaaatgtattattttaagacagaggcacattgtttttttttttttttttagatggagtcttgctctgtcgcccaggctggagtacagtggtgcaatcttggctcactgccacctctgcctcccaggttcaagcgattgagtagctgggattacaggcacgtgctaccacgcctggctaatttttttgtatttttagtagagacggggtttcatcatgttggtcaggctggtctcaaactcctgacctgatgatccacccaccttggcctcccaaagtgctgggattacaggcatgagctactgcgcccggccagacagaggcacattctttattagttctgtcaaaacatttatgctgcaaaacctcttttgtttgtttgtttgttttcaagacagggtcttgctctgttgctcaggctgaagtgtggtggtgtgatcatagctcatttcagcctcaaactcctgggctcaggagatcctgctgcctcagtctcctgagtagctaggactatataggtgcacactaccaggcccagctaatttttaaatatatatatgttgtagagatgaggatctcgctatgttgccaaagctagtcctgaactcctggtctcaatcgatccttctgcttggcctcccaaaagtgctgggattatggatgtgaaccacttttatttttaatgcaaataataaaatagggcgcccagccccctcttttatttttaatgcaaattaaattgaggaaagatttgccagctacctggatttctctaattcctttcctgttgcagagttttgttgctaagttcatatttggggtgataggcaaggtggtgagctccttacagtccagggcgctatcttcacttttgtctcctttgtacctggaaaactgactggctcaaaactccttctgttgaatgaatacataaacaagcaacaacttcagtaaacatttttcacctttcaaattccttttgaattagataggttacaaataaataaaatgtcttgaacagtgagaaagggaaaggcattaacatttaccaaatgccaatgtccaaatgagcttgtatgactgtttgctcattcaggtcttgcagcagccttgagtggtagacattatggacttgacaaatatttatcgatttattcttttgtgtcaggcaatgtggtaaatgctgaggattcaatacagtgggtcttgtaatgaactctccaagttatctgatgctcttccttctctctaaaacaggggtctccaacccctaggctacaggccagtaccggtctgtaataatattagaaataaagtgcataataaatgtaatgcacttgaatcatctcaaaaccaacccccctggtccgtggaaaaattgtcttccatgaaactggtccctggtgccaaaatggttggagaccatggctctaaaatgtacttattcacatgtgcgcagtaggtttgtgaccaaatggctactcttgaggacacctgtacttttctactcccatgattcagtgtatcattaccaagggtcagtgttttttaattcaaatctcttaatgtcagacgtacttgttactgcaattgcaaaatttaattgtacttatattttataaacaggaaatatatacgtgaaatgaaagttacttttatgaaaattaagttgaatgctttaggaagactcgatattgagttgtagggtcaagcattgtggctcacgcctgtaatcccagcactttgagaggctgagacaggaggattgctcaaggccagaagtttgagaccagcctaggcaacatacaaaagaagaaggagaaggagaagagaaaaaaattgagttgtaaacaattactatcacgtttgatacagtggaaactaaatgttttgaggggaaagtcaaagaagtctaaagatattttgtactgagtttgcttcataagtgacttgaggttctctttataattgacagtagaaactgtctatcatgtaatatggatcctgtttatacaagaaagatggcacagcactttcttttttttttcttttttttttttttttttgagatggagtcttgctctgtggcccaggctggagtgcagtggcacgatctctgctcaccgcaagctccgcctcctgggttcacaccattctcctgcctcagcctcccaagtagctgggactacaggtgcccgccaccatgcccggctaattttttgtatttttagtagagacggggtttcaccatgttagccaggatgttctcgatctcctgacctcgtgatccacccgcctcagcctcccaaagtgctgggattacaggcgtgagccaccgcgcccagccggcccagcactttcatcagtggacatatactcagcgaaaaacccaaagaaaagatttatgaatgagtatagttaagttaaaatggaatggttactgtctcttcttttaaaaatgatttttttgcttgagccaactgtctcactaatcatgtcagagaagacaaaaaccagtgagcaaaaccggacatagcctctgtccttgtggtacttatagtctagttggggagatagacagcaattgtattgtcagacaatcaaagttatccccattttcaagaaactaagaccttgcagaaattaatgttcccaatgttctggttaatgtaaccagcagactgaagaacagacaatcaaacccaagctcttaccatcaaattaaatttcctctaattctcagaccttgcctctcttttatttttttccctccctttcttcttttttctccttcctgttttcttttttctcttcctgagttgcaaggtttccatcattagttgatatgtgacaagatttcagtttattcagtcaatgcacttgatttattttatgtgacctgattatttaaaaaagttatatggaggattcttatcaggaatacattaaagtagtccttaataaaacttggtcaaaaaaacttaggcatgaatcccagttttaccatttactagctgtgtgactgtggatgagttaatctgctttcccatctctaaaacagagctggtaatatctcactcatgggattgtcatgggatttagatgaagtaataagagcccataacagagtacagggcacaaatagcgttcactgcataggcctgtaagaggtgagctgtgtcttccctttggatcttagtttcttcatctaagagttaggttctgctaggtatggtgtctcacacctataatcccaacactttgggaggccagggtgggaggatcgtttgagtccaggagatcgagaccagcctgggaaacgtagagagaccccatcccgcccaaaaatacaaaaattagccaggcatggtggtgcatgccagcagtcccagctgaggctgaggtgggaggatcgcttgggcctggaagttcaaggctgcagcaagctgagattgtgctactgcactccagcctgggagacagagtgagaccctgtcttaaaaaaaaaaaaaaaagttaggttctggctgggcgccatggctcatgactataataatcccagtacttttgggaggccaagttgggaggatggcttgaggccaagagttcaagaccaacctgggcaacatggcaagaccctgtctctaaaaaaaaaaaaaaaaaaaaagagttaagtttttcccaccatggcacatgtatacctgcgtaacaaacctgcatgttcagcacatgtatcccagaacttaaagtaaaataaaaaaaaatttaaaaacagttaggtttttctagttttataatcctttataactaaaaggttaatattttataatactatactatttttattgttgtctacttaggattaaggaagacttcatacacaaagagattcctgattcaaattgtatatatggatatatatatatatatacacacacacacgtagttcgtatgtgatatagacccatgctatttttgtctgttccaggtcaccccttccttcagtggtttttggcattaatgctttgtttaccaaatctgcccagtctttagcgcccatggtgatactctctaggctaaaccagtatgaatatggaaacacaaatagcaggtaaagtaaaaaaaaaaaaaaaaaaaaaaagctcttgaaataatgtaaaagaaacatgaaagcaaacacagccttttacgttaattactaagcaattatcttgacctttgtatattattagtcactaacttgtatcttgagtaaggtataataaaaagtattagtatcaaatggactttcataggagtatctttaagtatcttctttaaattatgtacatactaaatgtcttcacactaagctacatattaattactttatctgagttattcattcatttactatttcatttcacaaatgcttttgagtacctgcgattatagtccaggtacaaaagtcctttgaatacaggatgaatacaaaccttctaaggggccatacagattacacaaaactgtgataagggaccaccagaagtataattggactgcagtaattcagagaagagattcctacctggtctgcctacggtcagagtgtacttcacagaagagggtttcttcagctgagttttggaggctgagtgggatttttctcctgaacatggaggaatgtcattccaagtaaagaaaacagcacagcaaatatctggaagcatgtgtgaacttgccataagctattcatttattcatccaataaatattgagatcctaccaagtgctgagctctgtgatatggcagtgaggcgtagcagtaaacaaaacagcaaaaatctctgccctcacagagcttacattctaatgggagggaggcagaccaagaaatgaaataagtaaaatatatagtatgttagatggttatgaactctctggtaagaaacaaagcaagaaagaaaataggaagggttgggggaagctgcattttttttttttttttttaatttagagacagggtctcactctgtcgcccaggctggtgtgtagtagtgtgatcatagctcactgcagccttgaacttccaggctgaagtgatctcctgcctcagcctcctaagcagctgggactacaggcacgtgcctccatgccctgctaatttttaaaagtttttaggagaggcgtggtctcgctgtgttgcccaggcttgtcttgaactcctggactcaagcgatcctcctgccttggcctcccaaagcactaggattacaggtgtgagccactgtgcacagctaaagctgcatttttaattagagtgatggggaagacctcacgaagaaggtgacatttgaataaagacctgaaggaagatggcagggaaccagggaggctctctcagggaagaatgttcctgggagagagcacagcaagtgcaaaggcccagaggtgcagtgtgcctggcattctggctggcaaggaggccagcatggctggagcaaagtaagcaggagggagggaggcaggaatggggaaggaggccagattgcatagggccttgcagccctgtttgttactttgatttcaccgtaaggtgaaggagatggtgaaatagtgaaggattaactgactgacttaatagactttgtttttcaaagcagttttagattcacaatgaaattgagcagaaagtatacagtttccatatacccctgtccccgcacatgcacagcctcccccattgtcaacatcccccaccagagtgttacctttgttacaatcgaagaacctacactgacacattattagaacccaaattccatagttcacattatggttcattctttgtgttgtgcattctgtgggtttgggcaaatgtataatgacatgcatctatgattgtagtatcataaggaatagtttcactgcccaaaatatcccctgtgctctacctattcatccttccctccacactgacccctggcaaccagtgatctttttactgtctccatagttttgccttttctaaaatgttatctagttgaaatcatatagtatgttatcttttcatataggcttcttgcacttaataatatgcaatttaagtttctggtaggtctttttatgccttgatagctcatttctttttagtgatgaataatatccattgtctggatgacccacagtttatccattcacctactgaagagcatcttggttgcttccaaattttggcagttatgaataaatctgctgtaaatatctatgtacaggtttttgtgtagacataagatttcatttcatttacgtaaatgccaaggagcatgatggctggatcacatggtaaaagtatgtttgctttggtaggaaactgccaaactgtcttccaaagtggctatactattttgcattcccaccatcaatgaatgagagttcctgttgctccatatttatgccagtatttaatgttgtcaatcttttgggtttgggcccatctaataggtgtgtagtggtatgtcattgttttaaatttgtaattccctgatgacatatgagcatcttttcatatacttatttgctatctgtatatcttctttggtaaggtgtctattcaggtcttttgcccttttttaaaccaagttgtttgttttcttattgttgaactttaagaatttttagtatattttggataatagtcctttttcagatcctgcttttgctaatagtttttcccatctgtggcttgtcttctcgttctcttgacagtatctttcacagagcagcagtttttttaagtttcgcttatcagttctttctttcattgaccatgccttttgtgctgctgtatctaaaaagccatcaacatccccaaggtcacctagattttctcctgtgttattttctaggagttttctagttttgcattttatgtttaggtctgtaatccattttgacttaatttttgtgaagggtatatggtttgggtctagattcatttttttggcatgtggatattcattattcctgcactctttgttggagactatctttcctaattgtattgcctctgctcctttgtcgaagatcagttgactatatttttatgggtctattttgaacaatagaactaaatagtcctattgttctattctttcatcaacaccacacttcttgattactgtagctttatagtaagtgttgaagttgggtgtgtcagtcttctgactttgttcttttctttccatattgtcttggctattctgggtcttttgcctctccatataaactgtagaacaaatttgtcagtatccaaaaaataacttatggggattttgacagggattgcattgaatatatagatcaaagaagagctgatacattagaatattgagtcttcttatctacgaacatggactatctttccatttattttgatcttcttttatttctttgattttttttttttttttttttttttagacggagtttcgctcttgtcacccaggccggagtgcaatggcatgatctcagctcaccgcaacctctgcctcccgggttcaagcaattctcctgcctcagcctcccaagtagctgggactacaggcatgcgccaccacacctggctaatttttgtatttttagtagagatggggtttcaccatcttggccaggctggtttcgaactcctgacctcatgatccacccgccttggcctcccaaagtgctgggattacaggcgtgagccattgcgcctggcctgatttctttgattgattgattgatttttagagatagggcctcattctattgcccacactggagtgcactggtatgatcatagcttactgcaacctcaagctcctgggctcaagtgatcctcccatctcagcctcccaagtagctgggaccacaggtgtgcaccaccatgcccagctaaactttttttagagatggggtcttgctatgttgccgaggctggtctcagactcctggcctcaagtgttcctcccacctgagcctcccaaagcactgggattacaagcttgagccatgcccaggctgatttctttaattagaatttgtagctttccttatatggatcttgtacttattttgttagacttatactgaactatttcattggagggtgctaatgtaaatggtattgtgtttttactttaaaatctacttgtttatggcttgcatataagaaatagattgacctttgtatgttaatcttgtattttgcaaccttgttataattgcttattagttccaggagaaagtttttttttgtttattattttgggttttctacatagaaaaggatattgtttgtttttgagacagagtcttgcactgtcacccaggttggagtgcagtggtgtgatctcagctctgtacaacctctgcctcccgggttcaagagattctcttgcctcagcctcccaaatagctggaattacaggtgcctgccaccacacccagctaatttttgtatttttagtagagatggggtttcaccatgttggccaggctgatctcaaactcgtgacctcagatgaggtaatctgcccacctcagcctcccaaagtgctgggattacaggtgtgagccactgcaccaagccagattttttttttaagtttttcttacaacttttcctccattcttttatttatgaacattttcttttcttttcttttcttttctttttttttttttgagaccgagtttcgcttttgttgcccaggctggagtgcaatggcgcgatctcggctcaccgcaacctctgcctcccaggttcaagcaattctcctgcctcagcctcctgagtaggtgggattacaggcatgcgccaccacatctggctaattttgtatttttaatagagacggggtttctccatgttggtccggctggtctcgaactcatgacctcaggtgatccacccaccttggcctcccaaagtgctgggactacaggcgtgagccaccatgctgggccaaacattttcaaatatacaaaaaagttttaaaagttacacagtaatctacattcaactatttataacctactgtattaattttatcatgtattaattaatgtatccatccttctgtcaattaaaccatcttattttcctcacaactttttattataaaattttccaaatataaaaaaagtttaaagaaaattacagagaaaatacatgcatatacccacttcttagattcatcaattgctgacattttaccatatttggtttatctgtatctctgtgtgtatgcatattctgttctctggactatttatttttattttctatttttatttttagagatgggattctgctttgtcacccaggctgagagtgaagtggtacaatcatagctcattgcagcctcaaacttatttatttacttttttagagatggggtcttgctgtgttgttcaggctgatctccaacttctggcctcaagtgatcctcccacctcagtctccctagttgctgggattacaggtgtgagccactgtgcccggccactttatatgttgaagtttgtgtcatgtcatgacataaggtgctttctcattcttccttttttttgagacagagtcttgctctgtcgcccaggctggagtgcagtggcatgatctcatcacactgcaaactccacctcctgggttcaagcgattctcatgtctcagcctcctgagtagctaatttttatatttttagtaaagacagggtttcaccacattggccaggctggtctcaaactcctgacctcaaatgatccacttgccttggcctcccaaagtgctgggattacaggtgtgagccatcacacctagcctatatatcttttttttttttttttttggagacagggtcttgctctgtctcccaggctgagtacggtggctcaataacagctcattgcagctttgaactcttgtgctcaagggatccttctgactcagcctccctagtagctgggactgcaggtgcacgacactgtgcctggctaatttttaaaaatttttgtagagacagggtctcactagattgcccaggctagtttgaaactcctgggcgcaagtgatccttcctccttagcctcccaaagtgctgggattacaggcgtgaaccaccgcatccagccttctctgaaccattttaagttaaattgcagatctagtggcatgtcacccctgatagttaaccatgcatctcctagaaattaaaaaaaaaaacaaaaaaacagaaaaaatggcgactggacagtttttagttttgagcgggggtaattacctgatttgacttaccttttttttttttttttttttttttttgagacagagtctcattctgttcacccaggctggagtacagtggtgcagtctcggctcactgcaacctctgcctcctgggttcaagtgattctcctgcttcagcttcctgagtagctaggattacaggtgtgtgccaccacatccagctaatttttgtattttagtagagacgaggtttcaccatgttggcgaggatggtctcgaactcctgacctcaggtgatccgcctgccttggcctcccaaaatgctgagattaaggtgtgagccaccacgcccagccttgacttactttttaacagcctcccttggggtgccagcctcccttggggtgctgtgtaacgaatagactgaaaggagttaggagaagtcacatggaagaacctgttgattagtgacatgagttacagcacaattgatggcagctagagggggtgaagtcgaaaagtcaatcagggctgatgatgtgaaggatctgtacactggatttagaagatgtatgtgcttttaatcctatacattagggtttcacaaatatgatgaatttttgacatttgttatatgagtactctatgtactaatatttactcagtatttttctttaaatttattttaaatcactaacttaaaacaaatcttaactgccataagaaaaagcaaccataaaatcattcatttggtaggtttcaatttttctaacgccagtaaaataaaaagaaatggctggtggctcactcctgcaattctagcactttgggaggccaaggcatgatcacctgaggtcaggagttcgagaccagcctaaccaacatggtgaacccccatctctactaaaaatacaaaagttagccaggtgtggtggtgggcgcctgtagtcccagctactcgggaggcttaggtatgagaatcgcttgaacccaggaggtggaggttgcagtgagccaagattgtgccactgcactccagcctgggctacaagagtgaaattccatctcaaaaaataaaaaataaaaataaaaagaactattatgtatcatgtaaaaattatcatgtgtgccagcaggggtccagatgctgtactttgggaaagaccactctaggtaaagggaaatcactgaagatttgaatgcatgagacaaacatcatctgagccaggcatagtggctcacacctgtaacccagcactttgagaggccgaggcaggtggattgcttgaggccaggagttcaagaccagcctagccaacatggcaaaactccatctctactaaaaatacaaaaattagctgggcgtggtggcatgcgcctgtagtcccaggtactcgggaggctgaggcacaagaatcgattgaaccagagaggcagaggttgcagtgagctgagatggtgccactgtactccagcctgggcaacaaagcaagactctgtctcaaaaaaaaaaaaaaaaaaaagaaagaaagaaaaacatgatctgaattttgttttagaacaatctgtttatagtgtaaaagaagcactgaaggcttaattactaaatggaaaaatgaaggcttaactactagttgcctactatatcataagtgctcagaatatgaagataaataaaataggttgctgcaactagctgtttacaatctagtaaaggagacagacatgaggagagatttttgcagcacgaaatagtagatactatgattagaagtatatataagatataatggtggctaaaaggtgggcatgatcatcactgtcttgggaaccaagtccaggaaggcttcacagaaaaaaaaatgcttcagccaggtttcagtggaggcataaatactgtgcatggggccaggtgccattgctgatgcctgtaatcccagtgctttgggaagctgaggcaggaggatcccttgaggccaggagtttgagaccagcctggggaacatagcaagatcccctctctacaaaaaattgaaaaatttgccgagtatggtggtgcacagctgtaatcctagctacttgctaggctgaggtgggaggattgtttgggcctgggagttggaggctgtagtgagctatgattgtgccactgcactccagcctgtgtgacagagcaggatcctgtctcaataataattataataataatactgtgcatggagattggatgtatccagtgaagagaaacagtatagacatatgtgcaacgcatagatgtgtaaaatgatacagcattcattcaacaaatattaacacctactacgtaccaggtcctgtgctaaacccaaaggaaaaagaggaaaagatgcagcccccactctgaataagctcacagtcaattatagtgagaatcttaatgttggatgctaggtgctattacagatgtaagtgtgggctgttgagggagtgcccactggcttagcatacaattcagactgaggagaaaataaatgatctctctaatgaattttgaaaattcatagtagcagggagtctgtgcaagcacagagaggcatgaggttgtaggacatgattggaggaatggctgatggtttagtagtagagcttgagaagtgtagacctgatcctaaaaggaaaggagcattataattattaaaccaagaagtaataatatcagatttgccttttaaaagataaccctgggctgggcgtgatggctcacgcctgtaatctcagcacgttgggaggccgaggtgggtagatctcttgatctcaggagttcgagactagcctgggcaacatggtaaaaacccatctccacaaaaaatgcaaacactagccgggcatggtggcatgcacctgaagtcccagccacttgggaggctgaggcagaataattgcttgaactcgggaggtggaggttgtagtgagccaagattgcgccactgcactccagcctggacgacagagccagaccctgtctcaaaaaataaataagtaaaaataaaacattaggccgggcgcggtggctcacgcctgtaatcccagcactctgggaggctgaggtgggcggatcacgaggtcaggagatcgagaccatcctggctaacatggtgaaaccccgcttctactaaaaatacaaaaagttagccgggcatggtggtgggcgcctgtagtcccagcagctcgggaggctgaggcaggagaatggcgtgaacccgggaggcagagcttgcagtgagctgagattgtgccactgcactccagcctgggtgacagagcaagactccgtctcaaaaaaaaaaaataaataaataaataaaataaataaataaaataaaagattaccctgaagtgtgttttgaagggatgttagctggattgcaaagaacagttagaaggctaacaaagtgattttatatgaggaatgctggttccactggttaatattgtgcatggggccagtgtggtggctcacgcatgtaatccaagccctaaagcagtggaagacagaaggcaagaggagactgacatgagagattaaggagttagaaccgcagaactcagtggtatctcattatagaagcatggctcaaaattgggtaattgtggctaagaaatgagtatctgaatgaaggaagtgaatgtggactgtcctggaccgcatttcttctgtagaatgtaattcttcctcagactcatcttctccattttcgaggtgactgttttccacctgaactggggacattgcttgaaatccaagtagcagtaaaagcctcaagcaatattgtagtagaaaaccctggtgatggtcaagtgtggtggctctcatctgtagctctcatcttccagcactttggaaggccagagcaggaggatcacttgaggccaggagtttgagaccagtctgggtaacatagcaagaccccattcctacaaaaaaaattttttttaattacctgggactggccgggtgcagtggctcatgcctgcaatcccagcactttgggaggccgaggcaggcagatcacaaggtcaggagatcgagaccatcctggttaacacagtgaaaccccatctctactaaaaatacaaaaaaaattagccaggcatggcggcaggtgcctgtagtcccagctactcgggaggctgagtcaggagaatggcgtgaacccgggaggcagagcttgcagtgagccaagattgcgccactgcactccagcctgggtgacagagccagactctgtctcaaaaaaaaaaaaaaaaattagccgggagtggtggcacatgcccatagtcccagctacttgggaggctgaggtaggagtatcacttgagcccaggaattcgaggctgttgtgagctatgatctcactactgtactccagcctgggcaacagagtgagagcctgtgtcacaatcaatcaatcagtcattaggctgggctctgtgactcatgtctgtaatcccagaactttgggaggctgaggcaggcagatcacctgaggtcaggagtttgagaccaccctggccaacatggtggaaccctgtctctactaaaaatacaaaaattagccgggcgaggtggtgcgtgcctataatcccagctactcagcaggctgaggcaagagaatcattggaacccgggaggcagaagtcacagtgagccaagatcacgccactgcactccagcctgggcaatagagcgagactctgtctcaaataaataaataaataaataaataaataaataaataaaattaaaaccctggtggctaaaagaggacaggaacagaatctggaatagaaaagacccaaagccctgtatttcctgttatagcttatttgctgatagatgtcagagcaatggaggaatggcaagtgtgtttttaacctatctctctgaattttctttgtattctcaaagaacacgaaggccctaaagcaatagttctcaaccttgttgcacattagaatcacttggagcctgaaaaagtcctgatgcccagaccataccctagaccagttaaatcagaatgtctggggcgtgagatccaggcatatgtgtttttttaaaatataaaacaatacttcatttcctttattacctagttgtatcgttaaaataagaacaaatacagtggaatggaatacttcatatgacttcatgtgaaaaatacttcattatacaataaacaaccctcatgcatttcaacattgccaccagtaacactaaagactcccagttctattcatatgtgatcatcactgccctacaccccaaccccagctcctccaagcttcaacaggcatcagtatttttcgtagcccctggcttattccatcatgcagccaatgtgggaatctagagattgacttccttggaaacagaggctctagagactaattcttattggctcagctatagacacgttggcagccagacacgttggcacactagtctcatggtactataagcattttttagaggtataaactcaaacagcacactcaagtgtcatttatctttgagtgataatttaacagttggcatttggtggccccacatagctaatgctaatctgaaagtgtccaactgaagtccaca

SEQ ID NO: 357 - DNA, 664714 bp, Homo sapiens
taaccaatcatatcccatataaggttgaaacatccaggtttataaaagaagcatcccacccagcagattgaagactctaacacattgatttaattacatttgtataagcattgtttcctcagaatttttgctttatggaaaaagtgaaccatgaattgtgttcacataaacacataataaagcagttcattccataataacaatatttgtatatcacatataatataaagtgttttgtaaacttttataatttaatttaatctcataattcactttcataatttataatttaattgtataatttaatttaatcttacaacaatcacatatgaaaagtacagcatggggcgtctccaagatggccaaataggaacagctgtagtctacaactcccagtgtgagtgacgcagatgatgggtgatttctgcatttccaactgaggtaccaggttaatctcaatggggcttgtcagacagtgggtgcaggatagtgggtgcagcccaccgagcatgagccaaagcagggcgagtcatcgcctcacctgggaagcacaaggggtcagggaattccctttcccagccaagggaagctgtgacagatggcacctggaaaattgggtcactcccaccctaatactgtgcttttccaacggacttagcaaactgcacaccaagagattatatcccgtgcctggctacaagggtcccatgctcacggagcctcactcattgctagcacagcagtctgagatcaaactgcaaggcagcagcgaggctgggggaggggcgcccgccattgctgaggcttgagtaggtaaacaaagaagccaggaagctcgaactgggtggagctcaccatagctcaaggaggcctgcctgcctctgtagactccacctctggggacagggcatagccaaacaaaaggcagcagaaacctctgcagacttaaacatccctgtctgacagctttgaagagagtagtggttctcccagcatggagtttgagatctgagaatggtcagactgcttcctcaagtgagttcctgaccctggagtagcctaacagggaggcaccacccagtaggggcacactgacacctcccacagctgggtaaccctctgagatgaagcttccagaggaaagatcaggcagcaacatttgttgttctgcaatatttgctggtctgcagcctctgctgctgatacccgggcaaacagggtctggagtggacctccaacaaactccaacagacctgcagctgagggtcctgactgttagaaggaaaactaacaaacagaaaggacatccacaccaaaacgccatctgtacgtcaccagcatcaaagactaaaggtagataaaaccacaaagatggggaaaaaacagagcagaaaagccgaaaattctaaaaatcagagcgcctctcccctgccaaaggaacgcagctccttgccagcaacagaacaaagctggacagagaaagactttgacgagtggagagacgaaggcttcagacaatcaaacttctccgagctaaaggaggaagtttgaacccatcacaaagaagctaaaaaccttgaaaaaatattagacaaatggctaactagaataaccagtgtagagaagtccttaaattacctgacggagctgaaaaccatggcacgagaactacgtgatgaatccacaagcttccatagccaattcgatcaactgaaagaaagggtatcagtcatggaagatgaaatgaatgaagtgaagtgagaagagaagtttagagaaaaaagagtaaaaagaaatgaaaaagtctccaagaaatatgggacagtgtgaaaagaccaaatcgacgtctgattggtgtacctgaaagtgatggggagaatggaaccaagttggaaaacactcttcaggatattatccaagacaaattccccaatctagcaaggcaggccaatattcaacttcaggaaatacagagaacgccacaaagatactcctcgagaagagcaactccaagacacataattgtcagattcaccaaagttggaatgaaggaaaaaatgttaagggtagccagagaaaaggacaggttacccacaaagggaagcccatcagactaacagcagatctcttggcagaaactctacaagccagaaaagagtgggggccaatattcaacattcttaaagaaaagaactttcaacccagaatttcttatccagccaaactaagcttcataagtaaaggagaaataaaatactttacacacaagctgagagattttgtcaccaccaggcctgccctaaaagagctcctgaaggaagcactaaacatggaaagaaaaaaccagtacaagccactgcaaaaacatgccaaattgtaaagaccatagaggctaggaagaaactgcatcaactaacgagcaaaataaccagctaacatcataatgacaggatcaaattcacacataacaatattaaccttaaatataaatgggctaaatcctccaattaaaagacacagactggcaaattggataaagagtcaagacccatcagtgtgctgtatttaggagacccatctcaggtgcagagacacacataggctcaaaataaagggatggaggaagatctaccaagcaaatggaaaacagaaaagggcaggggttgcaatcctagtctctgataaaacagaatttaaaccaacaaagatcaaaagagacaaagaaggccattacataatggtaaagggatcaattcaacaagaagagctaactatcctaaatatatatgcacccaatacaggagcaccaagattcataaagcaagtcctgagtgacctacaaatatacttagactcccacacattaataatgggagactttaacaccccactgtcaacattagacagatcaacgagacagaaagttaacaaggatatccaagaattgaactcagctctgcaccaagtggacctaatagacatctacagaactctgcaccccaaatcaacagaatatacattcttctcagcaccacatcgcactattccaaaattgaccacatagttggaagtaaagcactcctcagcaaatctaaaagaacagaaagtataacaaactgtctctcagaccacagtgcaatcaaactagaactcaggattaagaaactcactcaaaaccactcaactacatggaaactgaacaacgtgctcctgaatgactactgggtatataacaaaatgaaggcagaaataaagatgttctttgaaaccaatgagaacaaagacacaacataccagaatttctgggacacatttaaagcagtgtgtagagggaaatttatagcactaaatgcccacaagagaaagcaggaaatatctaaaattgacaccctaacatcacaattaaaagaactagagaagcaagagcaaacacattcaaaagctagcagaaggcaagaaataactaagatcagagcagaactgaaggacacagagacatgaaaacccttcaaaaaatcaatgaatccaggagctgactttttgaaaagatcaacaaaattgataggctgctagcaagactaataaagaagaaaaaagagagaagaatcaaacagatgcaataaaaaatgataaagaggatatcaccaccaatatcacagaaatacaaactaccatcagagaatcacctctacacaaataaactagaaaatctagaagaaatggataaattcctggacacatacaccctcccaagactaaaccaggaagaagttgaatccctgaatagaccaacaacaggctctgaaattgaggcaataattaatagcctaccaaccaaaagaagtccaggaccagatgtattcacagccgaattctaccagaggtacaaggaggagctggtaccattctttctgaaaatactccaatcaatagaaaaagaggaaatcctccctaactcattttatgaggccagcatcatcctgataccaaagcctggcagacacacaacaaaaaaagagaattttagaccaatatccctgatgaacattgacgcaaaaatcctcaataaaatactggcaaaccaaatacagcagcacattaaaagcttatccaccatgatcaagtgggcttcatccctgggatgcaaggctggttcaacatgagcaaatcagtaaatgtaatccagcatgtaaacagaaccaaagacaaaaaccacatgattatctcaatagatgcagaaaaggcctttgacaaaattcaacagcgcttcatgctaaaaactctcaataaattaggtattgatgggacgtatctcaaaataataagagctatttatgacaaacccacagccaatatcatattgaatgggcaaaaactggaggcattccctttgaaaactggcccaagacagggatgccctctctcaccactcctattcaacatagtgttgaaagggcaatcagacaggagaaagaaatgaagggtattcaatgaggaaaagaggaagtcaaattgtccctgtttgcagatgacatgattgtatatttagaaaacctcatcacctcagcccaaaatctcctttagctgataagcaacttcagcaaagtctcaggatacaaaatcaaagtgcaaaaatcacaagcattcctatacaccaataacagacacacagagagccaaatcatgagtgaattcccattcacaattgcttcagagagaataaaatacctaggaatccaacttacaagggatgtgaaggacctcttcaaggagaactacaaaccactgctcaatgaaataaaagaggacacaaacaaatggaagaacactccatgttcctggataggaagaaccaatatcgtgaaaatggccatactacccaaggtaatctatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcatgctacctgacttcaaactatactacaagaccacagtaaccaaaacagcatggtactggtaccaaaacagagatatagaccaatggaacagaacagaaccctcagaaataataccacacatctacaaccatctggtctttgacaaacctggcaaaagcaagaaatggggaaaggattccctatttaataaatgatgcttggaaaactggctagccatatgtagaaagctgaaactggataccttctttacaccttatacaaaaagtaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccacaattgacaaatgggatctaattaaactaaagagcttctgcacagcaaaagaaactaccatcagagtgaacaggcaacctacagaatgggagaaacgttttgcaatctactcatctgacaaagggctaatatccagaatctacaaagaactcaaacaaatttacaagaaaaaaacaaacaaccccatcaaaaagtgggcaaaggatatgaacagatacttctcaaaagaagacatttatgcagccaacagacacaggaaaaaatgctcatcatcactggccatcagagaaatgcaaatcaaaagcacaatgaaataccatctcacaccagttagaatggtgatcattaaaaagtcaggaaacaacaggtgctggagaggatgtggagaaataggaacacttttacactgttggtgggactgtaaactagttcaaccattgtggaagacagtgtggtgaatcctcaaggatctagaactggaaataccatttgaaccagccatcgcattactgggtatatacccaaaggattataaatcatgctgctataaagacacatgcacacatatgttcattgtggcactattcacaatagcaaagacttggaaccaacccaaatgtccatcaatgatagactggattaagaaaatgtggcacctatacaccatggaatactatgcagccacaaaaaatgatgagttcatgtcctttgtaggacatggatgaagctggaaaccatcattcacagcaaactatcgcaaggacaaaaaacaaaacactgcatgttctcactcataggtgggaactgaacaatgagaacacttggacacagtaaggggaacatcacacaccggggcctaccgtggggtggggggaggggggagggatagcattaggagatatacctaatataaatgaggagttaatgggtgcagcacaccaacatggcacatgtatacatatgtaacaaacctgcacattgtgcacatgtaccctagtacttaaagtataataataaaaaaagaaaagtacagcagatattgtttctatattacggataagaaaactaaagctcagagtgggtacataaatcaaactagtcatgctcctggaaatagtgaagccacaacctgaatctaagacttttaaaattccatactaaaacttgtttactgtaacactatgaatgaagttgtttgctttgattaatttttttgtatatgcattttgatatgccaatcctttactcttcaattctgccaaatttacttgctgaacatattccaccacgtcttacaataagatgccaaatagcatgaggattcttgtccttctctgacctctcttttgagtttcctgcctgggaaagattatgaacaaagagaattgagaaagcagtttagaaaagaatcaggaaccatgaatcaccatcactgggttcacttgagactggattcactgggtttttctgagactccaaggaacctgtgggaaaacaaaatcgaggatgagaacttaggcaaaactcaaagtttgtgctctcttccttcttctaaacttgattaggccagtggttctcaattccaattgcacctaaaagtatctggggaactctccaaaaatgacaaaacctgagtcacactcagggccaataaactcagaatctttgaagatggagctgggatatggggagtttacaaaagctcctgggtgcttccagtgcgcagccagggtttgagaacgagtgtgatgtcataaccaccagatctcaaaggcaaagtggggaaccacagtagctcttaaaataagcatccaccactgctccagagaagggtagagacctgagaaaggcctgcactgtgcctggtccaggaggaaaaatgggaatctgggtcaagagacagccagattcttcatgtcatctctagcagcaagtgctagaatagagggaacattcttttcttcacccagcctaacctttccatttctatatgttacccaagttatttctaactggtaaggattatccctattttcaattatcattgtgacattcatgattgtgttgttggtgttgttggagctttgactgttagggcagtgactggtaacagaactataatctttcaaaggtgcagcatttattggcttttatttgaacttaaaataagtgacctattgcttcttgcactattgtcaactataagtgtgtgggaaaaaatcctatctttgcccttgatttatgacaaaaatatttttaatgtgaaatcattcttttgatgtttgcagtacatttcaaatgaagatggaatcttttgccactattcagaatttgtcccatctgccccaataaaaatacaagttatagattcaagaatatccataggaatcctttaactctgtatcaacagacaaagaaatcattcttgaaatacatctgatgacatgatagactggtaaagtcaaatctctccagaagcaaaaattaactatgattacttgatgtaagacatcactcaaaccaatcaaatgttattttgggaaatcataaatttatatccagtgtcagtttgtcactcattaagttcttataagaatgattaggaaattaacttaataagtaaacgttagtcttaatctcttcttactttgatggcttaaaaatataagtttatatcaattcattgggtctcactaaatgactctgcctgcttggagggttatttattctactattaataaactttaggattgacaagaaattcttgcattgctccaatctgcaacaaatctacctaccatgtgttagtacagctttcaaaatatgattttataattaacattaataaatatttgctgggtacctactatgttccagaccctgtgaaaggtgctagaaatatatgaaaatctcattaccttaaaattgtttccatacacaaaaattccaggagcagactttagtcttgccaaggtgtcattttagtgactgacatggatcaccactccctggcagtcaacaatgacagcaagcaaagctgcttaacagggagttactgatcttccagctgtattttgcttgtcactgctttgaaagatgcttactttgaagatctccatcatgtggaagagaaaaggtacaatgtaacctataaatcaaggaacagcgaggttttagagacacaagtaaaccaccatgtaagtaactcagagagctcacaaagaaggtaaacatggtgaataaaataaagagttcgtgaacttgatgataaaggaatcaatttcttctccaataaacattttgtaagcactgtaccaagaatagaagaaaagagtctccgtcccaccccttgcccaaaggaagaaagagctaatcacaggagatgctccagaatgcctaaagtatcataatgaatagttctactaatgtccacttttcaatggaaagtatggacctcttagattcgcttccaaattcctcccaaaatgactgtcaatactcttgttattgaacctggaaaaaaaagtttctaatatattattgatcacttatcaattccccaaactgacgacagcagttcttagattaactgttaaaccttgttcatcatgattatgctgaatgtttgtatgcagtttatgggttttatgtctgcagtcattccttcatttttccatagaaatgatataaacaatgatgatgtaatttaaattttattcaatttactggattttaaatgttttctacatggagaccatgaagaggaactatgttcagagaaaatgtctacaaagcaggaccatggccaaccacttttaatttaacccaattcactaaaagtacaataaaatatcatctatttggaatttattaattttaaatatgtgaaaatccacattgctgaagttgatctgtgaaattatatctagatttgaataccagttcaccacttggaaacttattgattaaaatttctaaacgtccatttactcatctgtaaaatgggtacaatctctttattttttctaattactgctactgctagcactctattccaacctacaaacattttgtgcctagaatagtacaaaagtctcctaactggttctcctgactccattcttgcctactccaccttccccccgctgccaaaaaacaggctattatttacatagagaccagagtgatttgtttttttaagtcagattatttcactcctctaatagaaattctaatgacttcctctttcactcaataaaattcagactccttgtggccaaaaagacccacatgagctacccccacccacacccccactaccatcacatcttccctaacctcatcttttaccactctgccagttggtccttccaccctagttacatgggcatttcacataagctctgcacctacctgaaatgcacttcccccagaatgccacatggcttgtctgcccactcttcttctcagctcaaatgccaccttccctggttatgttatttaaaataacattccatccttaatgtctcagccactctgtatcctcctcgccctgttttattcttcttcacaatacttctcagggtgtgacttagaagtggcttttgtttaatatctgtttccctgagaggggaaaaccaattagtctctctgagaagaaggattattgtctcttttattcactgctataccctctgcatggagaatagtgcccggcatatagtaaattctcagcaagaatataaaaatggatggtttcttctgcttagtaatgcctttcatggcctactttagttacttaaaaataacaaattcatttttcttaatatactccataaccaagtttttcactaactcagatctgatttatacctgaatgaatgttattctgtcagaagggataaatatgtgaccccattaagacaaaaacttggtaacagatctttttgaaatcttacaactattttactttcttggaaaatcagcctattttgttctttttatcagtttaattggatatctgagatgatcttagttatgatgtcttgcccttaataatcttggttaattatacaatagctggtacaattatataatattgaattttaaaattctcttaaatccatgtttgagttataaacttaaaatcaccaaagctgggtgtggtaattttaaaatatggccccagatgatttcacagcccttccattgggaggtagggtctatctctcctccccttgaatgtgggcaaacttgtgacttcttgacttacagagcacaggcttcctgggctagatcagaataggttatgcaacttccaccttattctctaagaatgttcacacgggggtaagccaggcaccatctgaagagtctgcctaccctaagacctccctgatgaagaggccatgtataggcactccaaccaactgtcccagctaagctcccatttgacagccagcatcaactgccggccaccagcctatgccaggcttcaaatggccacagccctagctgacacctaactacaaccaaatgagaaacacaaagtgaagatggccaaccagcctcttcctgaatttctgacccacaaaactagagtaaaattaaatatttgttgtttttacacttctacatttggaagtcatttattacccagcaatagaaacttatacagcaggaaatgctgtctcccctgtattgttctgactctgttttccacatggtaagaaaacaatccatggaaaatgtagtggattttatcaacattggttttgattcacacaagatagaaaatcattaaaactcgaaaggcatgttgatttcagtgttctgaaaatgcagcctgtataagctgtggtctatcaagaccactgagttagagaagaggtagttaaattatgggcctgctcaccaaatgtggcccaccacttgtcgtatataaaacaaaataaatatagcctacaaagcctaaaatatttactatcttgtcctctaccagaaaggtttgctgatctctgagttgaagaatggcaaagttagaaagagaatgtaagtgttctaagtattcttttcttattatgttgttgggcaaaaatatcatttttcaataatatcagtatattttaatgggcctatttcatgattctgatcagcacttcttaaattttttaaggatttttagttgtttttgttttgggagttcccccagccccattttttaggtctccttgttttgcttttagttttcctatcaaaagaaagagataagtcacaggagaaggaatacacatcacagttttctatgataccatcagtgaagcaaattcatatcaattgaagaaaattaatatctgaggtcaggggttggcaaactttttctacaagggcaaggatatttttagctttgcaaaccacatgctctctgtctcatctactcgaccctgatgtttaacagaaaagcagccacaaacagtgcttaaataaatggctatgtttgtgtacaataagactttatttatagaagcaagtggtaggctggagttagcctgcaatcgtcattagcccacccctattttggataatgtagggacacacgcacaagcagggaggtagcagggatgtggcactgctgcttgagatgtttgcagttgtaaatcctatacagagaaggaaggggaatacaatacatgagattcatgtcataacaatattttgcctgtttactacatttttttattcagtatactctaaactattatccagtttactaataatatcgaattagagttgagttagtatactgaaagacctcataagttaaaatttagtctttattattacaacttgaaaatcttacctttttgcagtagatttagttcttcaagatataaaaagaggtcatttcagatttcaatagccccactaaaacagctacctcccagcctgagagtcctgaaacaggcttttttccctctgttgtcaaaccttcctaaacacagtattcgcagactgtgtggtatgttttcctcctagttttcagaatccctgaagttcttccaatacaaaaaaaaaggcttatttttaccagttggtggaggatgttccactttcaaagggagagaatttttaattccctccatagggcttcatagctattgtaaacttcatgggcaggctttcacctgcatagaggaccaattccacataatgccaaccattctagggtaaaatggatggggtgagggtgacagtaaccctgtacccattactagcacatagttaaaaggtaatatgaaaatagactttggggaaaattttatgttttatatttacctcaaaataaatgcctacttagacaaaaaataaaattctttccactgctaaaagcaaataaataaatttcccagagattcaaaaatgaaaagaatattacctttgtccctaggatagatatatagatgaatagatttcagagcattttaaaatgcactgaaaaagtaagcaactaattagcaattagaaatgtatagtaacattaattacataaatataagtgtacatatataagtaattataaaaagcaaggcacaaacattataatattactttcaaccagttcaatctgaagaaaaggaaattttgaaatgtttgctttgaaagctcagagaattatccacgtgtgaaaaaatccaaaattgcttcaaagtgtaaaaattattcttctttccacctacaagtaagtcaaaattgctgtgcacattttcatcaaaatttcttaaaagaaattatccagcaaggaaaatctttgaagctatacaataaaaacttcagggacaaaagaaaactattctcagtgccttcatctatagagtacaagcaaaacaaaccaccctttacacacaagcacatgtgtgtgtacgtttattaattgattcaacaaaattttactgagagtcatgtacattaatttgtacacaattgtatgcatataggcatgtgtattttacatgagtataatcatatgtgtgaatatatctgcaaaagcaaagccaagaggaaggcctaaggataaagagcaaatattcatgtaaagaaacccccaaccacatgaaggcaccagaaattattctatatatacaaaaatgttgtatatagtgatgttagagatcataatgaatattggaggtgagaacaggatgacctcaagggtatccttctggagcatcagaaatgtctttgatgggcaatgatggagaggcacctgctcttaggagaggacatggagggaaaggcagaaaagataaactgtgtcacatcactgtttaagagcaatgaccaaaattggaaattcttctctaaactttttaattaaacattttaaagtaaaattgattatttaaaaatactccttaagttgtctggaaggctgcttaaatttgtggttgttttggttgtaattaataatagtaataaccactgttttcacttctaaagtaagaaaaagtagaggctggccattaacttttctccttaatctctggcaagcctatatttcaattgccttttatagccagaaataaggaactaaattagtaatccatatataagatgcttctcaggtaggtagcaacttacctagtaatactagggaaaaggatgctcttaccattactgatacaccatcatgtagtctccaggccagtgtgcttgttgaagttaacaggtagctgcagccatcataagattaccattgggaaaaattcaacatgatataatattaaacagtaatttctgcagagataaaaacaggttagtcattataacagccagaccctggatttccaaactaatagatatctggtttttaattctgccttagaaatataatgcacacctattggaagcttattatttcataagagaagtacataggaaaaaactccaggccctaggaattgagaaaaagaagttcatttttttgaagtgggaagaatgtccagaacctattagaacctacattccctccattgctcttcccaggaagatcaacactcactttatcaagagaaaatgtctcactgtgaaaaaacagggcccattgtgaagctgaaggagccaagcagacttgtctgcttaagacctaaaggtctgcccaagagacagagccctgaaaagaagtgaacctagtcagcacagaaagcatcttggcaggagccatctaactgcaaacaccaatacctctatagcttctcctttagaaatagtgccagaccaagccagcttacctggtcatctttcattcccaactagatctgcccagtacctcatggcaggtgatcaaagaacactaccatctcggtgtggcctcccagccctatacctgccaggctgcagcctgcccaacgcagggtggcagggtcagaaggacattttaaaaggggatgaaaatgacctttaatattttgagcagaatgataacttcttggcaggttatattgcgatagcactttggttacataatgatcatctcaatttcacattcattttaagaagtttttgccagaaaatagtaataacaataataataatggtgaaatacagggctttattccagaatgtaaatccttgaccaatgcttcctctagaaggataagctgtgacgctgcagatttcctggacctacacagtgagctgcctgttcccagtgacacagaagccatggcccaggcagctagtgcattctgtaacccagctcaatgaaaactaagagtttggcgccccctcttcctcaccagaggctctaattgtaatggccaccctgctccacctccacccactggtccagcgccaagttgcctgaaacttccccacaccacacacaacgtggctaacaagaacctctgttcccaatacatttgatcatcaaaatagcaccatgtttcccccagagaaatgcaatttcatctccatttcaagtaggttgatgtgtggtaatcagagggagacataaattttgaacttgagctttatgttgtgactagcattaatttaagtgccctgcatcaaagatctgagctattcctctaaactgctttaaaacccaccatgacttttcgttgtttcagaaacccacagtgcaatctgcaatgcattataaattttaagcaaagaatcttatctatattttcttgtgcattccaaaactccctaaaatactgatcagagacagtgcccacattccaagactagtgccacaagtttgctacaagttgagggaggaaaaaaaattaaagtaacagatgtttgggttgcctacttctgctattttcaaaacttcatcaacaatgcaaagttttaaattagaaatgtactatagttctattgttccctatggaaatttttaactaaaaccagagtctaggaattcattttcaaataaatattccaactttggttttaagaggaaaaactatacatatatatatatcctcttagaaggaatgaaagttccatctgatgagaagccccctccactcagcaccacagcagggagtagaattcaattggtggtaactgctccccgctgctcttgcagacttggtggctccatggggtgtgctctcaaggcttctgctgtccaaaggggaagctgtaggggatgctcacggccccactacagctagaaaattttgtgggtctggtcctgtcaatcctcgggatagctccacgtgaggtattctcactcacttcaaagacagggcagcttcagaagcccttccagaaggcttgcctgcatcaactcagcatccatgctgctcatccccctcctggttctgcatgcccagcaaggaaagctattagctccctcctggcctcaaaggaaagagggagcagagtccattgtttgctctcaaatctgcatccctggtggctagtggttcacatattaacttaattcaaaagattagcaacacagggcttaaattatataggattcagaaaagttctgatccaggctgagaatggagactggaccaacaagtggaaactcataaagtagagccagttttatttgaatgtaaattgatagaaggaagtcaacatcttttgttggtggtattgttcctaaaatccttttgtcctgtatcaatttccccatctcttccacaaaactactcctgactcaactagccacagtaatccctcctttctctgagctcttaaaaatacctgtagtatctgctgccaacttagcactttattatatacttacctgtattagcctctgtattatatttttaatactgactccccaaatagattttgagtgtctcaagggcaaacagaacgtcttacacttactttcaggacctatcacaggaagagtgaggaagggggacccaagaggaccatttggcataagcctcatatttaaaacaggcctcaaatttagatttttgatgacatctccaaataaggttatacctcaattttcatagacgtactggcaagagtttttaaaagaagcatttcatccaacaacttaaaattcatcagtttctatgatgctcttttggtattacttattttaatactccagaagcctcaaaaaatagaaataatttagtttacctcagattttctgtagtgcctggcactctgttacaaaagataaatgcagaaaatgttccctaatggtcaccagacatgctgcagatggagggaagaagtacagaactgttacagcacttgactataacaaaagcagagttagagacccagggcaactgaaaagattctacgcagactggctacagtgagcccctaaagcggttgtgtgtgttttcagggccctctctcctgtacagctaccttgtctccttcctgataacaacattagcatcaaaagaaggggtctgtcctctttgtttgataatgaagcacctcctaagaagttgaagataaggcagctttgtaaaccagtggaacttagagacaatagctgtgcttcaccaggtgtgagagaaagccgagcaggaaactgtctgtgaggtgcagccaaaagattctaaaaaatccagaactccaatcaaggtagtttccagaagtgatctcagggaagcaggactagcatgtgattctaatgtaatccagaatcccatactgtctttggagaaagatactgtgacacaaagtgtgtgtgaatagtaaagggaaacacaaattagccatgagttcattgtgtgtgttccctttgtgaagagactcaggggtagttggtcatcttcagatgacacctccaagacaaccctgcgttcaaggcacctctttctaccctattcttgacctcagctgatgtggtagttattagtactgttcaccaaatttttctggctctccatcttctggaactttatagaattgcattctcctattcttcatcgcaattagggatagccttggcttgttttagccaatgaaatgtgagtgacttaagagccagagaatgagccactgcgtctccattgtcctaccttgctcatcacagatcatgacgaaaacagagacagagacttgctctgcaaaggtcctgagtgaaagaagccaagctctccaaatgaccagtgggggcgatttaatatgaagaagaaacaagcctttgttattttaagccactgaactcttggaattatttcttaacacagtttaacccaccctattctgattgataaaatcagcgattacctcaccatgcttaatcccctgatcctcaaactgaagtgccttcagggttatgctgttctatgccaggggattagagaagccacaggataggggaggcacatgttaccagagcatccaccggactcactgttaatttaaaatgttatttttatattcaaacatacacaaatgagtacaaaattttattagtttttaagatgaaagaggagatttcaaagaatttcagaagcacagatttagtggataaaataaggcattccagtagagaaggggcctctgagagaagcagcctcagtgaagagaagagaaactgaggcacagagaatctatgtgactcatccaaggtcacacagctagggaatgcagcccaggttggctgatccaaggccagagctcttttggccacacacacctaagcatgtgcagtaatgattcttctggtattctcaacaacataagggagacagccatcctcatgtgagaaccagccattgcctcttcactgttgactaaggatgccggcaatgaggtagctgaccttgctaccaaatcatcactgttcacagacagagatgcaacaaatattctgccttcctttctttcccaacttctcaccatagaaagataaaaaatagataaagtttgcctttccccccaaattttccagctttcaatctttataatctaataaattatctccatgttgggggtcattaaatataatgagctattggagaaaaaagtgtgtgtgtgtgtgtgtgtgtgtgtgtgtgtgtgtgtgtgtgcctccaagaaggttccccagtgatgaacaatgccttaatagctatctttggaacaaggcagggtttgaataaataaccttctgcagtcagtttagtgccagatcattcttaaaagcaatatcttaggtaaagtttggaagtaacatttatgttttctttttttaattgaaacttagctttttcagtctcttttggaattttatgaacctaaattttcaagtgggagaattcaaagcagatgaaaagcaaccagattttttaaaaaagaaaaggacttaaaaatcataacccaccctcactcacagtctttcagagctaattatatatagttaagataatctgaaactctagaagcacccttgccaacattctttgtatctataaaatcagcctatgataatttaagatcaatagtttgtaaaagtcaatagtcgagtcctacctcttgtaagtgtggccagtttctgatgcagacattgccaattgctcagcattgtgagatgctctgagccatgtaagtccatgccattcaatgtccacaagcattaactcaggtttcttagtaactcattttttatgcacatcactcacaaagaagagctacttttatttttgcacaagtccttgctcactttcagaggacatagctctcacaaatacactttggtttccttgctctctcagtaaacagatttttttcctgcaatgctcttttggtgaaacttgttttgagaacagtgagtaccaccctacatcagattttgtcggttatgctgttattgcagatacagaagaaaagtttgtttgaaatttccaaaagctctcaaaataaatgccccaggatggtccccattctacctgtccaaatttgtcccccatcctctccctaaagtcctccatccccgtcaagtacaccccccagcaacattccaagctggctctatctctgaggttttgctcacactatttaaacacacgtgcacccagtgtctgtgatgcacaaattcttctgtctgtcaatgtaaatcctgtccaaccttcaaagcctaacccaagtcccaaagactcctggaacacttcccatatcaaatttaccctcaacaataacccacttctgtgaattctgacagcaattgctgtgcttgccatgtattctgatgtttagccctattccattttacatcatcctgcaattgcttcattgtgtatttcttagatctttcatttgatcaaaatgtcataccatggagggtatatgtataaaccaaagaatgaaattcttcaggagagacccacatggtaactaagatctttgtatctttcccaattcttagatcatcaactttcagaagttttccaggtctaatctacaatgagcatagaaggtacagagagcttcatctccacccatctaccacaagagtcacccctcaaattgtgtgcctcttggagtcatactcaaatgaaggccaaaactgagataaccacaattagccactctagcaaacagactgcttcaccagcaaggctgaaacatcaaccagggccaggtggtgggaattgtacaaagaatcagacagaagtaatgtgtcatgcataaccagaggaatgtcagctacagaccttgccctcagccccacaggtataagctatcctccaggtaaatagcctgcatcacaaagatgccatggagcacaggcatcctagacacacccagggaatgagaccttgaaaagccaagtgcctatagcatataagcaaatgtcttatcataaataaagtaaagataaaaacaggagatttctgttacctttggagataatatatagtcctatacacacttaaatgttttagcagagtggcatgtttagtaaagtgtgaaattttcagtgttttttctgcattagtcaacaatattattcagatggtaaataagttcacttttcctggcattaatagaggtagattgccgcatacacacacacacacacacaaacacacacacacacacacacagtcttccttagactttatccttttggttaacaataccattcaaatgtgcaattcagctgctcatccctatagaggcaaaatgttatttaaaaagttgccttcagtttgtgcctattgctctagggcagcagttctcaactaagggtgaatctgcccccaggggacatttgccaaggtctgaagacatttggggctgacttgactgggatagtagtattggcatgctggtaaacatcctacaataaacaggacaatctcctacaacaaagaatttactaggtccaaaatgttagtagtgtcaaatttgagaaactctgtcccagaagtaaaagcaatacaacatttcaaggcaagaatgcttggccaggtgcagtggctcacacctgtaatcagagtttttggaggccaaggcaggaggatcacttgagcccaagagtttgagttcagccagggcaagatagtgaaacccttgtctctacaaaaaaataaaaataattagtcaggtgtggtggtacacaccttgtggaggctgaggtgggagaattgcttaatcctatgaggtcaaggctacagtgagccgagatcatgccactgcacttcaacctggacaacagagagagaccctgtccaaaaaaaaaatgccagattgcttcttgtttgagggaaatcactttaataatcctttgacttatgcaaaagaaaagtcaagatcttattttgaaataggtaatttcagactctaagccctactgatggctttgtgaacagcgtctctgcagagactggtatgatattaacttcctattaaattcttaaattcgttgagtgagaaaggaagaaagagtcaagaagtgtcccagatttccaggaaggactgatttgagggaattctcttctaaagagggagataaaataacgctcagcaatgtcacagtaggcaagaggctaaataaagccagtcaaaatggtgctccccatgttgagcatggcagatggcatctggaattggtgggatttcatccagctgtaagttttcccttttcacactgttattctctaacacccgcaagccttcaaagaaagttttataaagcaccacggcctagtgttcactgtgtctgaggaaataagaattacctagtcaaggatgtctttagaggaagtaggtaaaagtgtgaaggaagccagggcagactgggagagcagtgagataccacaacctgagagtggcatagggggaaataaggtggggcagaagcttcctagagcacccaacagcatatgggaggttctgcaaagcagcagggaagttattgagtcaagttggctgtcagaagaatctggcatctcccaggaatgaaatgctttagtatccttgcatggtctagtcactggttgagcccttaattggcaaagcccttaggaagagtggcctcaaagtaaacggagccatagattcagagtgcaacagccaaggtcagttacagtccttatactgggaggtcagcaaggtgcattctcatggccacatcatgaataaaactataactagctatttgcgtgataagaggaagtgtttcctggaacttccatgtctcaaccccaccatctgttcatatgccctcttttctacaggagtagcaacagatactttaattgctgattaatctctcaaaagtaaatagctgccaaccgagtgtaagaataaagaaaatgagaagtcaattgttctaggatcaccagagaagcagaaaactctcagactttagagagtgcccaaattaagaaactcttcacccaccttttagcttcacttgaaactggcccaggatatgccattcagggccccactgcagggcaccttggcgtgttgccagccctctgtcatacaatgactgccagctccttccagactttgaaatgctctatgagagaaccatcattacctaccatagaacttctaagggaaaattgagttgaataaattattagcaatttcataataaacttcaaatcatcctccatacattttcttctaactgccagagtaattcatatattaaacatttagatagtaccatcattccttgtcaactttcccttgtgagagattgttaagagtagagcattatgttccaggagagtttgagttcagaaaggcctcaaggcagactgtgagctagaagccttctcaaaggcctgccagctctgtgattttatgatttctgatgaaaaacgatagcacattgagaaactgtccctgaaacagaaaggaaagtcagtggagaagccagccttagggaatgcctcacttcctagactatctcctaaaatatagactatatattagaaccatagatactcatattgtccctttatttctgagcttcttttggaataagtggttattagaagacagtatttgtttgcatttgtaagcattccaaaaacagcatgcagaaggacaagtgagccttaaaagagcatcatgagatttttggttttggtcctggacagaatgtcaagcatgacctgcagttatttttccaataacagtgtgaaccaaagtccatttctccattttgtcttacacacccacttgccagatctaaacagaataaatattgatacagtgacttcagacaaagttaaagtcaagttggcctaaagcaccaggaacatcagaaatgtcccttagtgtgttcttcattcaagtccttagaatttttggttgctctgacaataaaattactgcacacattgttttcatcttctatttgtagaatactagaacacaaaaatgttattaacttcacaaagtgtgtatacacacacacacactcatacatgcacacaaaaaatgctcagcttgtcaacagctttagtgaagtaaaatacaattgataattagaaacatgtgtccccagcaaagaggcacagaaactaaaaggtcatctttttccaaatgacctaattagaagagcctggagtgctggctacagtataatggttttgcacagcttttaactcagacttcctgttttaaaacagtgcaatttactgctcctgcagcaaatatgaatggtcacttaatgccaacagaattaggccttacaacaccacctgcctccagcaatctcattgttagacccatcagctgaggattgctgatttaccatcccagaatgacgatttagaacctagtgccaggattgctgccaagttgagaacaaggatttcatgtagaagagagcccacttggtactttatattaatgccaattgaaatatgcatgaatagaccagaggcaaagcggttgttcagaatcagactatcagtgaatgcttcttaggttcttttttttttctttttggtcctagagctaggattttgatgctgaataattttaattgaccagagacaacagacacaaactggctgaaaatgctgcatggtagaaacttaaacagacacccaaatagaattgtcattttaaatagacacctctgtaaatctgtacttaatctctctcatatgtattcagtatttcgtgatgtttcagcaagtattcatcttgcttgtctttttctttgcctcagttctctcatctgaaatacctaactaatgctttggagcagcaatgttaattgaggactgtgaagaataaaaattcggtaacagcaatggatgctcagctacagactacatttctcagcctctcttgtagctaggtgtactcatatgacgaagtttggtctcacaggatgtgagtggaaaggatgtgtacaacttccaatgcacctttatgcagatggtttgccttgaattttctctgtccccctgttgatggctaagaagtgatgataattttagcaaccttgggtaaacaaccttgggtgataaagctttcctgacagccttggatcattcatctatatactcttccatgagagaaataaacttcaatcactgttaacacactgtggatgagggctactttgttaagctgtacctcaactaataaaagcaaagggagcatcaataagttgcatctactcttgtgcccagaattttgtgtatatcttttgcatcgttcagttcattagtaaaccaaactgaaagtaactttaactttggctaatccttatttttgccaattcttgaactaaacttgtctttaatatcaaacttagttcatgggctctgttctgcaaaataaggaagatgaggctgttgaagttgcaaaatccagtggtttaaggttctgaactttactatgactggaagtagaccaatctgaaatatgtttctggcattgtatccaaagaagtacatctgtaaatgctgtttctataatttcccagatagaaaagttttgatacatgtattttccttatataatagtttctttgcaatattttaaattcctatctgtccactggcttcttcctttggacccttagtcactcaaaggtctatttgaatttataatatctcttaactggattcttctgttcctctgataagatttgttttatgcatcactttccctacccaaatttctcagtgtggtctaggacaactgtttctatgcctatattctcattctctccttaaatccctaaacctgtgtctgcttcatcccaatctactacaatttcacttaaaagataatcactctattttcccatttcttatgttcctagactatttacacactcagcaaacatttattgagcctcatccatgtgtcatgaaataggcagattagaatacaaagcacagtgcttgaagatcttcacagttttataacattggaccgttttaaagaatctccttgaacttcttatgatttccatggaaacacaccattcttcttctcatcctactgttctgattatttcattctttttctgggctgatccgctttcaataccccttaatagaggtttcctccaatgctcagtaccaggtcctctgctctgcctttgtactctctccttttgaaatagcatcagttgttccagcttcactgactgtcttttgtaagtgattttcatttgtctctgggcataaacttccacccaagcttcagtttcattgtcccaattacactttattgcctcaacccatgaaatcccaacatgtttaaaactaaacaaatttctttaccttacatatactcccattcctatgcctcatctaatatattcctctgacatattctcctacatacatgtacatcaactttcttgtcttgctctctctttctgggttaaccaagcctgcctggacaatagtaaaaacagaagttccaatccaagcaatctatttccttgtctgctttaattcaggccaactcactcatagtagcaggcaaacaggcatttaccttccctcagagcatggtgtcttttatgcagtgccaaataagtgggggaacaaatgaagaaatgtcaataagcaattacatatgtactaacaacgttaacctgacaagtatttgaggaagaagtaatatgcttagtctccaaagagttctcaaatattcaggcttggataaaaatatttataacagaaaagcaacaacaaaaatccctctaatttttgttctctcattttctacactcatgatgttgaacagactttcctcaggatggccctatagcaccgtctaccccagaaccaaatcagagaagtactcctggttccttccatttccactgtactttaaaatgggaagctacgtttcctttcctttccttagctatggttgatattaaacctacccgtctattatcctcttatttttggttctacttttttggcagagacctatttttcttggattattttttacacatgtttacatgtttcagaaaaaaaaactatgagatttacttttgtcttattctgtatttcatctcatatatgcattctttttcttgtttgctttatcattcaatcattcatggttcttaaatgtaaacagacataaaaaaaatgcttaaagaatgaatgtatactgagtcttcaggatgacctaagagtcaggtttggtggctacttggtcaagactaatgcccaaaccactctcggagactgtccagcaaaaaccacagccacactgcccagggcactcagcacaggacatcagaaattgttctactgctgccccagaagggcagggtctcagccaccaccttcaccagaaatgagttaatcattgtgcctactttttcccattgcttacttctgaactgaagtctcactgagggccatctgattggtaatagctcagtcatgactctgtcatacctatgaggaaggctgggaaaatgaattactatcctcagccctggagactaagaaggtaagaaatatcctcaaactagaaagggtatccaaggattctatacaaataaaaaggtctgacaaatatccactacattaactcactggctttcctttcccacttctctatctctgccaatgttgccatcattttaccaaatagcaaggcttctatcagtcatgtgttatcttttttctccttcatttcctgaatacaatcaatcaacaattactttcaagaaatccactacttatccagtataattactcatgctggagaaattcaaacaaagtataagccatgattagactgaaaatcttagaaataacatagagaaaatagttaaagaattataagtagtataatgagaagattgattttaatacaataaagattttgaggagagctctatcagagtggataaagaagttaagaaaggaaagttttatagagaaattcagtattaaattaagctttaagtttgagctacagatgaggaatatacagaagaatgtacttgtgctttttccaaaacctcactaaaataaaagtaaagagatgaaaagctatgaacctataacaagtgctacttagtcgagaacaatgtccaaattacactgacagaatgtcccacaaagattccacctacactgcccaaggcgcccagaatagaatctggagaggggccattggcagacaaaaaattttaacaaaattgttgaaaatcttaaaatagaggaatgataactatgtagatgaaaccacagattagaaagttttcaaggagaatgcatctaataaagaggtcggttagccctcgaaactctggacttacctgccatgtgctagagaaaactctagaaaccaggtatctgtccttggaaagagaatgaatgctcttcctttataggaacctgaatgagcctagagaaagaccacattctgatccatagggcttttctagcatgagtgtcagctcttcacataataactgtaagacaataccttccagtccatgagccacatccaaaaacatagatttcccatttaactttttgaggtcttatttttaagtatagacaagattatcagacttgaggaaaacattcaagatgcaagaaaaagacaaaaagaataataagaatcaaaaagaatatacaaccccaaagacaattaaaactgtaaacattttttaaaattctttaacaattatattgcatctattacacagaagcatggtgctatgaaaaaaaaagaagtgataataagaaaggcctctggcaaattaaaaaatataagtgaaattaaaaagagttaaaagataaaatatatgaatctcccaaaagattaaacaaaaagagagaaaaaaaatatgagatggaaagtctgacagaaattttataaaatataacactgtggtactggaggttcaccatctgacaaaagaaagaacagaacaaatggaaagaaagaagttgtttaaaaaaaagtacaaataaaatttccaaagtttttgagattggtctctagctcccaacaccccactaaaagaatagaattattattgaatgaatgaaaatcatcataccatggcatgttctagtgatatttcagaatgtcataaaaaagaagagacgctaaaatttccctccatgaagcaatatccagtactcttacacagaaatttgaattcagaatgctgcttctcaacaacatagaatattaaagagtgaaaattgaagcaatgcctcaaatttctgagggaaaacacttttcaatgtttatatctttagaatttaactaaactataaataatatgtttaaatataaagacatactcagacaggtaagaactcgtacaattttcctcacacacaccttttcttaggaagttatctgggaatgtgatccagcaaaagatgcgagtaagccaaaaataagccaaaaaattacaccaaaaaagaaacagttgactcaaccaaggagatatttcttattctaagcttactacattatagcaagcttgttaatcactctcccacataggaacaaaaagatgaaaaataagtaatgaggacaccaggagaaaacatttcaaaaacttttttttaaatgcctgatatggtaaagggtttgaaaaataagtggagagttactagaaggaagctatgaaagttatttgaaaccaatgaaaaaaaagagacaatgtaccagagtatctgggacatagctaaagcagtgttatgagggaaatttatagcactaaatgcccacattggaaagctagagagatctcaaattgacaccctaatatcacaattaaaagtgctagagagggaagagaaaactaatcaaaaagatagcagaacaagaaatagttactaagatcagagaagtattgaaggagatagagacaggaaaaaccctccaaaaaaaaaaaaaaaaaaaaaaaacaaaaacaaaaacaaaaatgaatccagcagctggttttttgaaaaatttagcaaaatagacctctagctagactaatgaagaaaagagacaagaatcaaatagacgcaatagaaaatgataaagggaatattatcactgaccccacagaaatgccaactaccttcagagaatactataaacatttctatgcaaataaactagaaaatctagaagaaattgataaattccaagacatatacaccctactaagactaaaccagaaagaagttgaatccctgaatagacccataacaagttctgaaattgagtcagtagttaatagcctaccaaccaaaaaaagtccaggactagaaggattcacagccaaattctatcagaggttcaaagaggagctggtaccattccttctggaactattccaaacaattgaaaaagaaggactcctcctaactcattttatgaggccagcatcatcctgataccaaaacgaggaagagacacaacataaaagaaaactccaggccaatatccctgatgaacattgatgagaaaatcctcaacaaaaccaaatccagtagcacatcaaaaaacttatccaccaccatggctggatgcagtggctcacgcctgtaatcccagcactttgggaggccgaggtgggcggatcatgaggtcaggagatcgagaccagcctggccaacatggtgaaaccccgtctctactaaaaatacaaaaaattagccgggcatggtggcgggcacctgtaatcccagctacttgggaggctgaggcagaagaatggcatgaacccaggaggcggagattgcagtgagctgagatcgtgccactgcactccagactaggcgacaaaatgagactccatctcccctccccaccaaaaaaaaaaaaacttacccaccacgaacaagttggcttcatccctgggatgcaaggctggttcaatatatacaaatcaatacacataatccatcacataaacagaaccaaagacaaaaaccacatgattatctcaatagatgctaaaatgtctttgattaaattcaacatcccttcatgtaaaaaactctcaataaactaggtattgatggagcatgtcttaaaataacaagagctatttatgacaaacccacagccaatatcatattgaatgggcaaaagctggaagcattcccttggaaaaccagtacaagacaaggatgccctctctcatcactcctattcaacatagcattggaagttctggccagggtaatcaggcaagtgaaggaaataaacggtattcaaataggaagaaaggaagtcaaattgtctctatttgcagacaatatgattttatttggagaaaccccatcgtctcagccccaaaactccttaagctgataagcaacttcagcaaagtctcaggatacaaaatcaatgtgcaaaaatcacaagcattcttttttaccaacaatagacaaggagagagccaaatcatgaatgagttcccattcacaatcactataaagagaatgaaatagttgggagtacagctaacaagggacgtgaaggatctcttcaaggagaactacaaatcactgctcaggaaataagagacaatgcaaacaaatggaaaaacattttatcctcatggataggaagaatcaatatcatgaaaatggccatactgcccaaggtaatttacagattcaatgctattcccatcaaactaccattgacattcttcacagaattagaaaaaactattttaaatttcatacagattcaaagaagaccctgtataaccaagacagccctaagcaaaaagaacaaagctggaggcatcatgctaccttacttcaaactatactacaaggctatagtaaccaaaagagcatggtactggtaccaaaacagacatatagaccaatggagcagaacaaagacctcagaaataacaccacacatctacaaccatctgatcttcaacaaacctgacaaaaacaagcaatggggatgggatctcctattcagtgaatggtgctgcaaaaactggctagccatatgcagaaaacagaaactggaccccttctttacatcttaggcaaaaattaattcaagatggattaaagacttaaatgtaaaacccaaaaccataaaaaccctaggagaaaacctaggcaataccattcaggacataggcatgggcaagtactttgtaacaaaaatgccaaaagcaattgcaacaaaagccaaaattgacaaattagatctaattaaactaaagagcttctgcacagcaaaagaaactatcaccacagtgaacacgcaacctccaaaatgggaaaagatttttgcaatctacccatctgacaaaggtctaagaatttacaaggaacttaaatttataagaaaaaacaaccccatcaaaaagtgggcaaaggatatgaacacacacttcttaaaagaagacatttatgtggccaaaaaacacatgaaaaaagctcagcatcactgaccatcagagaaatgcaaatccaaaccacaatgagataccatctcatgccagtcaggatggcgattattaaaatgtcaagaaaattttcttccattttgtaggttgcctgttcactctgatggtagtttcttttgctgtgcagaagctctttagtttaattggatcccatttgtcaattttgtcttttgttgccattgcttttggtgttttggacatgaagtccttgcccatgcctatgtcctgaatgataatgcctacaatgatagactggattaagaaaatgtggcacatatacaccatggaatactatgcaggcataaaaagtgatcagttcatgtcctttgtagggacatggatgaaattggaaatcatcattctcagtaaactatggcaagaacaaaaaaccaaacaccgcatattctcactcataggtgggaattgaacaatgagatcacatggacacaggaaggggaatatcacactctggggactgtggtggggtggggggaggggagagggatagcattgggagatatacctaatgctagatgacgagttagtgggtgcagcgcaccagcatggcacaagtatacatatgtaactaacctgcacaatgtgcacatgtaccctaaaacttaaagtataataataaaaaaaaaagtcaagaaacaatagatgctggcaaggatgtagagaaataggaacacttttacaccgttggtgggaatgtaaattagttcaaccattgtggaagatagtatggtgattcccaaggatctagaacaagaaacaccatttgacctagcaatcccattactgggtatatacccaaaggaatagaaatatttctactataaagacacatgcacacatatgtttattgcagcactatttacaatagcaaagacatggaaccaacccaaatgtccatcaatgatagactggataaagaaaatgtggtacatacacaccacggaatactatgcagccataaaaaggaatgagatcatgtcctttgcagagacatgggtgaagctggaagccatcatcttcagcaaactaataaaggaacagaaaaccaaacactgcataagtgggagttgcacaatgagaatacatggacacagagagggaaacaacacacaccagggcctcttggggggtgtggggggtgaagggaaggaacttaggggacaggtcaataggtgcagcaaaccaccatggcacacatatacctatgtaacaaacctgcacgttctgcacacgtatcccattttttttagaagaaataaaaatttagaagaaaatgcctaatatggtaaagggtttgaataacaagtggaaagttactagaaggaagctatggcaagaagagaaacatttgaaacttctgtaaaaaaaaaaatctgtagaagacaataaaatgagaatggtaccttacttagatctagaaagagcaatattcatgtagtcataataaaaatggatttgattaaatatagtactattacatagagatgataggagaaatggggagtgtaagaggcctgtatccttatcttcagggcagtaagtaaatcatttctaaaattgatccatcaaaaaatagcagcatagttgaatggcttttaagggttaaagagtctttcctctgagcagtaggcctgcggagaagggaccacaggagagtttggttttcttttcagcttttctgtactattactttttttttaacatgtgaatattaactttgtattttaagcctttttaaaatagagaacttagcagggtgaataggatttggcaaccctgagagggtgagagtacacatcaaaagaatcaagaagaactaacatagcaaaagcaccatatcagacttatgtctggtgaaaagccaggcctgatcagagcatcagtgtcacagcaaaacacggacgaaaggaagggtggggccaggccactgaggccagcagtgggttggaagcctttgtagatgcctgagtaacaccttgatgagagcagtgttttaggaaggtctgaagggctggactgtgcaagttgccacagagggagagatgcaactttcagtatctcccctactccaatacatctggtctagtacgtccaccaaattcatttttctcccagagtcataaagcacaaccatcattcattcctctcacttctgaactggaattacaataaattagccaaattagtattcagggctctccgtgatcaagatcagcatggtggctgccaacaccagctgatttctgggcaacaaatcaaaccagtctctaggcaatcattatcaaactgtggtcctcagactagcagcatctaagttacctgagtggtaacttgtcaaataataaattcttgggcccatcccataatgttgaatcaagccgggccttccagatgattctgatgcttcataaagcctgagaaccattactgtaaaggcaactaattatatgacctagagcaaattatttagcttctctaagctttggatttctcatctgaaaaacagagacaatactgtctacctcacaggcttatggaagagataaatttgaatccatttggtgcatacaagctcagtaaattattttaaaatatcatagttttagttttttaaaaaatattttatattctatggtccagacaagccattctactcagcattccatacaccggtgtctgcattgtattaactgtctgtgaaatggttcttccctcaagaaagaaacgatctaaggcagaaccacacatactcacacactaataaaacttaataaatgttggaactgacattttaaatagtgtttatcatgatgaaaaggaaagttcaaattaagtcatcctaaaaaggctcaaagaaaagcttagcagaaaaggaatttaaagagtggtaagatatcagcagctggacaggtggagaaagagtaacacagtcatgacagtgcaagccaagtttaatataatccttttaggtgcaacagctacatttctcattcatcactaggcaaatcctgctatgggaggcgcttccctctcttactattttctccacatctgaccttaagctacactttacctcttcatgagcaacataaacagtctttttcaggatgataattggattcatcatatggagtgtttgggggatcacgccttgaccttcagatggccattttagcactctggcctcaagttttccttctctgtgttctctccactttttacctggctcctttcctaggtcccctagcctgccctcacccacataaattctgagtctccgaaatcaatcactttctgtactaagaatgatcttctcatgtctttctcaaaaatcactttacttttggtcaaaattcaaatgatagctatctcctttttggaatcctcagctattcacaaccagaaatagagcctctgtaagtaatctcagagcatttctgattttctattatagtctttaacatgggtgtgctttaatacacctatccatatacctcctactatatttatgaaactttaaagggcagagaccagatttttgttcatcctttcatgtccctttatgataccttacacataaatgttcagttcttgttagctgaattgaattgacctctcttgctcagaaatctccggttatacccacatgcctataccatcaagtctaacatcagaatcttgctgtcttttgtggctgcatactgcccattcaattttatttcctacttgaccccaatacaaatgcaccaatacagctttatcagtgattctcagcaccagctgcacattagaattccctggagagctttttaaaaatgccattacccaagtccctctaccaaagatttttatataattggtcaaagatgaggcctaggcatctgtactttttaaaagcatttgggatgattctaatggcaaccatggttaagaaatactgagctactgtatttgcttcactttttcctgagagcaatttattcaccctcgacaacattttcatgctcttctacctagccattttagtaaaactcacacacctctatatttgtgcaggatctggttcaggctcacctctttcaggaagccttccctcactacccctatctactctgatctctcatagtcttatattttattgacttactatttcacaatttctagtggcagtgcttgacttgccagtacaaatgcctgcagggcaggaagtcttgtctgagaaactcaataaatatgctgaactttcaattatcactttggtttgatcacatttcaagatgaacactttatacaaaataaagtaaaaataataaaactcagtgtataaatatatgctgattatatttccataactgtgtagagagcccaaatcctggagtcaaacatacctgaatttgaatcccagctccagcactagttagttgtgtgaccttgggcaagttacttaatctttctaagtctcagttttctgatatttaaaaagtgagtaatagcagtacctaccctcattaaattgttgtgaatattaaatgaaataaggtatgtaaaatctttagcaaaacatctggtacatattaagcaatcagttcataaatataattatttattatttgagtgagggttttacacctaactccttttaaatccacactttcttgaaaaaagcatctatcttttatatattttctcaaaagcaaagataagcgatcctttgtgctttattgctatatctaacaagattatttcaccataccaaagcttaactgtgttactattacgttagaatgttcgttatacacaatactctaagtaatttcagtgcttatggatatatcattacattatatgaagttactgacaatttacaggtttaatttagtgactaaatagtaggaaattctgattaagaattcgccagaggggagaaatctaattgaaggggagtgaagtccataccatggaccatttagctgaattaaacccagcttccaagggatggtacagggaatgattagaatgctacagctctggttactacaaacattgagtggattaccaaccaatctacatctctacattttcgcactcaccacccatgacttcagagcatttcaataatgaaactctatagggagaaaaactgtttagatgtttttccttcacctattgtaatctcacagtcagctatctaacatacacagaagctgcccgcagatgacaccactgagaaatacagagaaaaggaagcatgaaggaaagaaggaggaaggcaaaggggcaaggggaaaagatcacacattgcaagtcatatgattataaaaatcaatgaaaattcattataaaataactggaaaatgtttaggtttttttactttgctctcaaccctactcttcaagatgctttattgttttgccatttagaaagtgcttagagagttctacaacagaagtacttcactgttttattaaagattatgtttaaatgtgcaaggaacaatttacagaaaaatccacattctctttggctcataggattcagccctagctgttaaaggctcaataaactgttattgcttcacattactgaatagatgcaactgtgaaaaaaaatataacaagttcacattctcattcattcttcacatttctcccgccttccttctcatctccttctagagctttatcctttcttctttccttcacccaatgtcattcctttcgctctgtaccaaaatacacactaacattctttaaacagtgttgttagatcaaagtgctagttttcatcctgaagtgtataggtttctgctgtgtttagcaagttaaaaaaaaaaaaaaaaaagcaactctgacagttttagattatcagtttcacatgcttggtacaagtgaggaaacttgagatgcaaaatcagtagaatgtatacaaactgcatttatttttttcatcaaagcacacactgaagtgtttggcttattgcctaaaactcaattatcagatttttttaattttaagaacctcatctttgaacatagaaatcacaaatatttcactcttctaagttttggggctttgcttagcaaattgaagtcaaaaacagaagtagtagtgtctgctgtttctgccgaatgattagtacaggcggaagggttatagaggttaaacaaggaaatcgtttgtttctgcctacacaaaggattatgagaacacttttcaatgtaaacacacttgagatgctgaggtatgttgtgaagagttaagctgtgagtcctgtgtgaatttacttgtttgtctgacaaacgaaaacatttcaaaggttatctatgcctggaagcttatgccaggcagagagaccttcacttctttttaacgtgggtttgggatactggggtgataataatatgtattgtgaatgaagtgcagataggaaaaaaagagtgaagcagataaaaatggggctttttttcctacttgtacaaattgatcattgcttgcttctccaaaggccaaaatatcttaactactgggaagccattgaaattatttcccagtattgtgagttgacacaggagaatagaaggtcctctttatttaaaaacttattttgcacccaaaataatcccatcaggccttcagtatttggtggcagggtttcggtcttcgaagaggaatacacaaattagaattgtttgggaacccactcaccacaaactgaccagttaacttttgtggaatcaacattagtgctagcatagcaacacctactggttaatttatgaagtaaagttgaagccaacatggccagaaatcagttcctccatcttttttttttttttttttttgagacggtgtctggctctgtcgcccaggctggagtgcagtggcacgatcttggctcgctacaacctccgcctcctgggttcaagcgattctcctgcctcagcctccatagtacttgggactacaggtgcgcgccaccaccactcccagctaattttcgtattttcagtagagacggggtttttcaccatattggtcctgacctcttgatccaccagccttggcctcccaaagtgatgggattacaggtgtgagccaccacgcctggcccagttcctccatcttaattagaaaaattaaagcatgttttttacctatgacgtctaaaattttacccattttagatatataaatgagtataaaaatgactgttttcaaattaaagaatgggaaagaaaactgtagttgtgaaagaaaaataactatgtttagggtgctactaaggcaattattacacttctcagtaattggaagttgccattcagccttctaaaaattatgttatgtagttcataagtgagactgattctttttcttctttcttctcctcccttcccccctctcctcctcctcccccttctcttcctccctcctcttctccttctcctcctccttttctcctcctccttctcttctcctcctcctcctcttcttcttctcctcctcctcctctttccttcctcctcctcttcctcctcttcttcctcctccttctcctgctccttttcttcctcctccttctctttcttcttcatacattttttaaagggggttacacaattacgggaagccattcatgaaaatactagatggatggaaataagctgagaggtatcatgtttatttttaccacagttatgaagtctagtcagtaaacaatgaatacagcatgtaatgccatagtcagctctaacactcctaaacaacgtcttaacttaaagagacttttaagaacagtaagtaccacagaaaatagagctgtagagaatatgactcataccaaaatgaaaatacacacaaattgcttcaaatcctgaacttcagtagaatttgaccttgccaatatttagaaaagccatagatcctgtctaactcctctattctgtaataatgccttgtaaaaacaaacaaacaaacaaacagaaaaacagccccgtgaactgaacaagaagcaatttgtcgctagttaaccaagttgtaagccaggacattgactggctgcacctgtatgttctcaagaaccgcaacgtgaagtcttcattcacggacaagcagctctgggaaggaatttaggaggtaggcaataggaactccacactaatctctgaagagccaaggcctgggggaaagcaaaaggatgaaaccaaggcaagcctggagactcccaaaactttgaagtaaaaatctcttccctcctagataaggtagtaattttttcttaaaatataaaaggattatatacattgtgaatctgccattctgagtttgcataattctacttttagttaacttgggctacataacattgtattttttccttaagacggtgttttgctcttgttgcccaggatggaacgcaatggtgccatctcagctcactgcaacctctgcctccctggttcaagtgattctcctgcctcagcctcctgagtagctgggattacaggcatgcaccaccatgcccagctaatttttttttttttttttttttggatttttagtagagacagggtttcaccatgcaggtgaggctggtcttgaacttctgacctcaggggatccacccgcctcagccttccaaagtgctgggattacaggtgtgagccaccgcccctgggcaacagcttcatttctttagttaacaacatagatacatccacagtacctatgatacatttctaagtgatccatttggtttaaagtaacagactgatggactctcagggaacatcaggaaattttgtgttcccaagacacagaaatatgtgggttttgtacaatgctgggaaaagtctaggcctttaccacgtcctgcttggattcctgcagccacctcctaattgctctctctgataatagttgtacccccaattctggatatttctgcccaatttatttgtctaaaatgtttattcagagtcatgtttcttttcagaaaccttagttgtttatcttgccaaagaattttcaaactccatagtttagtgttctttctagaaatgtgccagtatctccttttcaaccatggctctcattagccccttaacacaaacctttctgtcctgttgttagtcagggtctttgttcttagagcacccaagatggtggcgggccgctccaaagatggtggtggccgttcccaagatggcagcaagctttttgttctctgacctggggttcttggcctcacggattccaaggaatggaaccttgggccatgcggtgagtgttatagctctattagaagccgtgggtcaaggaagagaaccgtggaacccagcaactagtgttcagctcaattaggacaaacccaggcacttagccacgcaggaacaatggtgagcatctaacccaaacgggagtggcaatgggtgcctcactggatcagaaacgcagcagacaccctgctggatccagaggggtggaaagcgggtctgtgatgacggcgttcagcagtggtggacggccagtgaaaggtcagctcgagccaaaacaaacaaggaccagaagattatgcagttgcaggatttaatagagtgaaaacagagctcccatacaatgggaggggacccaaaggaggttgcccactcctggctcgaatgcctggggtttatatcccaatcattgtccctccccctgtgctctcagatgatagatgatttgactatttctttacctcctgcttttagcctaactgatattttagtgagccctatttaccacctgattggtcaagtgtgagctgagttacgagccccatgttcaaaggtgggtgcagtcaccttccccagctaggcttaagaattctagtcggcctaggaactccagctagtcctgtctctcactgtcaagctaatcagttgggttaatcaagtcctatctatcaagttcacattcattaatattgcctccacatctcaactggtggtgtctacctcctcctttccctgttactattacttctgcccccttaccccacccctgtaacagtgctttctcctcttcttctaccaaaatattcttccagcatcctctatataggcctcattccagacccacaggaagaattcctctgatttccttactaaaattttactgctccagacatacactatcttgtaacttaagttttcatttgtgtatagatcttcattcctatcatagtaacaaacttctctaggacaaggatgaaattttatacttttatatagcctccataactccaaacacaatacacaaatctgagaggaaacacacacacacaagttaaaagctttaaaaattactagatttgcattccaagactgatacaagatatcatctagcattaaaaaaactcacagtgttaagcactttcacatgcattttctcattgagcaaagtattaatatcttgaaatagtgtcaagaaactcaagaaattctcacagtttccacaggagaagataatagaaaggggagtggaattggaatgtggaacaccttttaatgactcagtaatccttacttattcaagaaggattaatcttctgagatagtaccatggtatatcctctgtaacttaaggccaacttactgcattttttttcattatttttattgtggcaaaatatatataacataaaaaaattctcatattttattactttgtaactcagactttgctagtttttcttcattatatatttctttttcaacttttttaaaagattatttcttcggacttttgtacttacctatagggaacataacttgaaaaaaaaaaaacttggggtgttcccggtgactcaggcctgtaatcccagcactttgggaggccgaggagggcggatcacctgaggtcaggagctcgagaccaggatcacctgaggtcaggagctcgagaccagactcacctgaatggtgaaaccccatccctactaaaaaaaaaaaaaaaaaaagtacaaaaattagtcgggcgtggtggcaggtgcctgtaatcccagctactcaggaggctgaggcaggagaatcacttgaacccgggaggcagaggttgcagtgagccaagatcgcaccactgaactccagcctgagtgccagagcgagactctatctgaaagaaaaaaaaaagaaataggaaaaaaaaaacttgggaatttttttataaagtgctttagatgtccatgagaccatggaaaaatatgctctggatatgccctggaatataaatcactctacaaattctacttatttttattattgctgcagttatcatgggatattcttaaatggtaaactttccccataataaaatgcatttggcatctgagcaattaaaccatcttatgccaagtcctctttttttaaatattgaaggtcttatgctttcctacgatttgtctaccatgacatctcaaattgttgttacagagaaataaaaggtcatgataacctgagcctgtgatgaacttgcttttgcatgtcctttcaatgtaatatttcctttcagtcatcagtttaaaggtagaatcactcagggttctcaaagggcaaaagataacttgcaatcctcagaaccctggagatgggcagggaagctgtcctccccacaaaggttatttgtaagaggacttctgagaagggagttgaaaggaagaaggagaggtagagaagagaagaaaacacagaattcatactatgtagtttccatataaactactccatgaacaaaagtaatatacctgaaagctaaacaaagtcagtaaaaactctgttaaaataattggcattgagaaagataaataagctcctgcctattgatctgaatcctttatgcccttcagttcttatttgacactacacgatggtatttctcttcatgaccccaatgtcttgatctgaaaaccaaaccagtcatttctcactgaggggggagaatagttttgttaacgtctgtttttttagctcttttatttttaagttgttactgaaatcgccttgatctgcctaccagggaactggagcacattccatgagcttgccgcctaaatctcttttctctttatttgttctacagaatattgatttagatttcggcctattcgcattgctttaaacttttaaacactgtctctaatagctagaggaaacactttgctgaagctaaaatgatcacccaagagaacttattgggaaaatacatcgaccaaaattagcccttggctctcaacgtacagctcccattgaaagcagtggaagccgaactcttaggatttgaagacacgttttctttgcattgaatataaaggctttttgaaaggattgtgcttatttgagtttctgttaaagaagctgaattagctctttgtcatattattaaaagagaggcagcattgattctccaatttgtctcctaaggggtcttttcatatctaacaaaattgcacagacatcctttttttttgtttctgtacactgattgtttaatactataaaggaccaggcatcataccaagagctttcagtcttcaatagttcctagaacattttactataacattttctaatcctttacaaccaaaataacaataaaaacagagcaatgtttagaatcaacatgggagaagggaaaaatggtaccaggaaactagcagtgtaactctctgatgtgagataacatcataagttcctgccgcaccaaattactgctgccataaattcctctcaggcttcagaacactcttttattacactgtggatagtgccattgagaaagatcagatttccaaaggcctcaccatgtagctgatgtcttgaactgctgaaatgctcaggatgcattaactggcacaaactgactctaagagtctgtggcaccatctgctctgaaagatgcaagttatataaatgtgttgaccataggaaacctctgcactagcaaatgtgagtcccctgcagcaggactcagcaacagagcacttttcagggttcatctccatgttaacacagtttaagcaggttgttagtttactcaggagagtcttgccctgttttccacatctgacaacaaataaaaaggcatgatgtagtctttgagataaggaagggcaagggccatgtctcacttgtttttacatatcttgctcctaacatcattcccacacagaagcaattaattaatatttatttactttgaataagttaggagtgagagacgccagatgacacaagatgtgccttatagacttgtaaaagactaatccttgaaggggcagagcaagatggtggaatagaaggctctacaaatcagtctccccacaaggacgccaatttaacaactatctaaacaaaaaaaaagcaccttcaataagaatcaaaaatcaggtaagcactcaccatacctggttttaaattcatatcactgaaagaggcactaaagaggtaggagaaacagtccttccacccttttctcatgccctggcagcagcaacatggtgcagagagcaattctgtgtgctggggagagggagagtgcagcaattgtgaggcactgaactcagtgctgccttgttatagcagaaagtaaaactggaccaatctcagctgatgcctgcccatggagagagcacttaaaccagccctagccagaggggaattgccaaccccagtggttggaacttgagttcctgcaagcctcgccactacaagcgaaagtgcttctgggcctcaaaaaaattggaagggaagtataggccacaaggactataactcctaggcaagacctagtgctgaaatgcacccagagccagtggactgagggagcatgcaacctactgacacaacagcttagggcagctaacggagtgctgatatcactcctcccctaagctcgggctgcatagctcacagctccaaaagagactccttgaggataagagagggaagagtaaggagaactttgtcttgcatcttgaataccggctctgccacagcagagtagggcactggtcagagacgtgaggccccctttccaggccctagttcctagaggacatttctagacacaccctggcccagaaaaaaaacctgccaccttaaagggaagggcccagacctgacagaattcatcacctgctaactgaaagcccctgggccctaaatagccagcagcaattcccaggtacaacgttcagggtctgaacgttgagtgagcctgagacttgctggcttcaggtaagactaagcacattcccacctgtggtggctataggtcaagaattcttctgcttgagaaaagtggagggaaaagtaaaggagactttgtgttgcactttaggtacctggtcagccccaggcagtagagcaccaagcagacttttggggtctggattccaagacttagctcttggatggcaattctggacctgtcctggaccaaaagagagcctactgccctaaaacatgagtcccaggcaggcagcattcaccacaagctgaatgaagagcctgtgaaccttaagggaacattggcagtagtctggcagtattccccatgggcttatagtggcagtggccatggggtggggctctttgcctttgcctttggaaaggggagagaaaagtggaaaggactgcatcttgtggtttgggtgccagcctatccgcagtacattcttagaacattagattgatttctatggtttttttactctaggccttgaatcccagacagcacctctaaactcaatcattgcctgtgggaactcacctccctgaagggaatgacacacacctggctggctttgctgcctgctgattgtagagacccagggccttcagcaaacttaggcagtagccagggagtggtgacagcaggccttgggtgagacccagtgctgtgctagcttcaggtctgacccagtgcagtcatagaggcggtggccacagaggggctcatgtcactccacccccagctctaggtggctcagaacagagagacagagattctgtttagaaggacataagggaggagaacccaagcctcctcctggtaatccagagaattcttccagatcttgtccaagatcatcaaggcaatacctctatgagtgtgcaagagtcacagtgttactgggtttggggtgtcccctaaagcagatacagcttagatgacaacacccaagttcttttgaatatctggaaagccttcccaagagggaccaatacaaacaagtccagaccgaaaagactacaataaatatctaattcttcaatgccaagacacagacgaacatctacaagtatcaagaccatcttagaaaatatgacctcactaaatgaactcaataaggcaccagggaccaatcctggagaaacagagatatattacctttcagatagagaattcaaaataactgtcttaaggaaactcaaagaaattcaagataacacaaaatgaattcaaaattctatcaggtgaatttaacacagagattgacataattgaaaagaatcaagcagaaatcctgtaacttaaaaatgcaattgacatactgaagaacatttcagagtgttttaatagcagaattgattaagcagaagagggaattactgagcttgaagacaggctatttaaaaatacacaatcactatttgaaaattcacaatcagaggagaagaaagaacaaaaaacagtgaagcacacctacaggatctagaaaatagcctaaaaagggcaaaatctaagagttattggccttaaagaggaggtagagaaagagataggggtagagagtttattcaatgggaaaatgacagagaacttcccaaacctgaagaaagatatcaatatccaaatacaagaaagttgtaggacaccaagcagatttaacccaaaaagactacctaaaggcatttaataatcaaattcccaaagttcaagggtaaagaaaggatcctaaaagcagcaaaagagaaaaaacaaatacagtggagcttcagtaagtctggcagcagacttttcagtggaaacctggccaggagagagaggcatggcattatttaatgttctgaaagaaaaaaacctttaccctagaataatatacccagcaaagatacccttcaaacatgaaggagaaataaaaacttttccagacaaacaaaagctgaaggatttcatgaacaccagacctatgctacaataaatgctaaaggaagtacttcagtaagggagtgctcattgttaatgaacagtgtgaaatcatctgaaggtagaaaacgcactgctaatagtaagtacacagtaagacatataatattataacactctaactgtggtgtataaagcattcttaccttaagttggaagactaaacaatgaaccaataaaaaataataaccaccacaatttttcaagacatagtacaataaggtataaacagaaacaacagaaagctaaaaagcggggagacaaagttaagttgtagagttctcctgtttgtttgtttataacagtgttaaattgttgtcagcttaaaataatgggtaataggatagtatttgcaagcctcatggtagtttcaaaccaaaaaacaaacatacaatagatacataaacaaataaagagcaagaaactaaatcatatcaccagtgaaaatcaccttcactaaaggaagacaggaaggaaagaaagagggaacagaagaccacaaaacaaccaggaaacaaaggatgaatggcaggagtaagtccttacttatcaacaataacattgaatgtaaatggactaaactctccattcaaaagacacagagtagttgaatgcattaaaaaacaagacacaattatcatttgcctataagaaacacacattgtctataaagaaacatgcagtctgaaaataaaggaatggaaaaagatattccaagtcaatggaaaccaaaaaagagcaggagtagctatacttatatcagacaaaatagattcaagagaaaaacaaagagacaaagaaggccactatataatgataaaggggtcaattcagcaagaggatacaacaatttaaatatatatgtgcccaacactggagcacccagatatataaagcaaatattattaaagttaaagagaaagatagtccccagtataatcatagctggggacttcaacatcccactttcagcattggacagatcttccagacagaaaatcaacaaagaaacatcggacttaattgtcactgtagaccaaatggacctaatagatatttacagaacatttcatccaattactgcagaatatacattcttttcctcagcacatgagtaattctcaaggacagaccacatgttagctcacaaaatgaatcttacagcattcaaaaaaatgaaataacatcaggaattaaactggaaatcagtaacaagaggaattttggaaactgtataaatacatggaaattaaacaacatacttctgaatgaccagtgagtccatgaagaaattaaaaaggaagttgaaaaatttcttgaaacaaatgataatgtaaacacaacataccaaaacctatgagatacagcaaaagcagtactaagaggaaagtttatacttataaatgcctgcatcaaaaaagaagaaaaacttcaactaaataatctaatcatgcatcttaaagaactggaaaagcaagaaaaaaacaaacacaaaattagtagaagaaaagaaataataaagatcggagaagaaatcaatgaaattgaaatgaagaaaacaatacaaaagatcaatgaaacaaaaagtcatttttttgaaaagttaaacaaagttgacaaacctttagccagactaacataaaaaagactcaaataaataaaatcatagattaaaaaggaggtattacagctgataccacagaaattcaaaggatcacatagtaggcactcaaattgtgaattgctgaattgaattacatagaaatactattgttcaaccaaatctcaagttgcatataatgaattagccgccatacagaaatcatgtgttattgaaattggtgataaattacttattatctgtaatgggtttctgaaaaatacttctctttccattaatgattttattttcagcatttgctggtcaataaaaatctcacattactgatgtaacttctcatcataggcagaattgaatattcatgcctaattcaaatcactgttgttctggcctgttgcttttttttctcctcagatagttaaatcctcatttgtataaaacatttattatactttgccatttataaactttatttcagtctgttttgttatattaactaaatttggtaaggaattttattagatttttatggagggtggggacataaaaattagacacaattaaaaatcttatacttgttttaaccataaagacatttgccattctttctacttttgctatatgttcctagtaacgtgtagaattcctcttgtacttaagtgttctaaagttttagcatcatactggtgaggagccttaataaatccaaagcaaattagccggtgtgagtactctctacgcgtatggatctgacagactgctaagatgtcatagtacaaagaagtgtacttctcttcctgataaatagacttgcattttaattttttattaaattatttgataataaagacaaacaatagcaccctagcgtcttttgtagaagtaattaagtctttgcaataagtgatttcgtgacagctctctgctattaataaattttagtgagagtagagagagattgttgaggttggtctgaaaattattggatccttagactagtgaaatgaatgagttgagctctactgtatgaaaaatactttccataataatttgtatgttaaacagtttataatgattctggccaggagcacaagaagccaccattaatttatactgataacccagagctagcatgttcctttatcaggcaacttctgaaaacaagcccaaattattgttgatgtttaatattaattaggttctctcttgccctgtggcttcctcaagtaactctctgatagtaaatcaaccatgaaatggctaagtgtggcctgaaacgatgtgtgtgctatcaaggagtaatgcaaaggcagaattggattaactgagtctcataaacatcctatagaatatactctctccttaccttctagaagattacattatgaaacctgacattcatcattgacactaggtttttttttttagaacaaacatctcttagatgaatactaattgcatattaacaacgtaactctcctattaaaccttcatagaaaagcaaaattgtacaatccattgacaaaataattccttaccattaaccaagcaataaccttcataaatttcccgagcatattcaggctcaagtcatgcactgtaatccaacatagtatccacttttggtgttctataccacattcagctctgtccagccacactcccttctaaacaagcacagcagatttacagccactacatcctctgatttccccagaacctcttccccactccttcctgataggtcccgtagtctctgaatccaatttgcttcccactgtcattctacttttatctccttctactctgctttagactagttgccaatgtttcattgacttttagaaagttttgttaatggcccattagggtttttttgttttgttttgttttgttttgtttttccttctgaaagaggaaggaaagctgatttcaatgatcatgttttagaagcaagcagctaaatggcaaccagacttttaaaatgccaaaggtcatcagttctcctgtgagttattatgcaaaaagagtcattgtttcttcttttactttgtggcagcattataaggtctctttctgctgccctagtttaatttgaacctggcctctgaaggcagatgtatatatgcagggacccagaaatggagcaggacccaggagggacttgatcctgccataatacagattaaggaaaatgtagcttctgacctcaaaaaaaaaaaaaaggtttgaaggctagtcttattaatgatgattcactgcaagtgagataaaacaacagacaaatagaatcctagaatcgtatagcaaaaaggggcttaaaaaaaagatcatctagtctgtttggccatctaaaaatgctcctcgagtgtctcacagacaagaaaactaattccttgggtataggtcaggcacgtgagagcatgatcatcattcaagagttttattcaccatgcaaaaaagcaggcaacgctccgaatgaagggttgaaatagcatgaatccagggtctggaacactaccaaagagttaataaagtggctaacaaagaacaaacagctaaatgacctacctggacctggtcaagagaaaaagctgaaattactacctgctgtagaaatatgacaaaatgttacatttacaaaccaaagcagtctcagaaaatgtaacaaccttagctgtaaagtgatgggttaacaatctccactttcacaaagaataaaaagtaacaggccagaataacagtgatttgagcaatgcatgaatattcaattctccctgtgatgagaagttacattaatgatgtgaggatttaactgacaagcaaatgctgaaaatgaaatccttaatggaaagagaaatatttttcagaaacccattgcagataataagtaaattattaccaacttcaataaaatatgatgatgcacatgcaaacctttaatgtctaacattaggcatttctaaaatacaggtttcagagagatgagcacctttgttatgctcctttttttttttaaagtatccacttctcctcgagatttcttttagctactaataaaattaaagctgttagagtcttaaaggtattctttacttttaaggaataaggaaaagtagaggcttatctttcttccccactaataaatacaatttttaaagtagtatgtgactacagttttttggatatgtcaataaatgcatatttataagttatagattaaattttactaagaaataatatttagatttccatcaagtcaggtataaaatagaacttattttatcacattttaaaaacaaaggcgttcaattgtattcaatcattaggtgttacgttgttgttctcaaggaccaaaaaaaaaaggcttcttgttaacagtgttagttcacagagcaaaatgtatttggaatacatggtgggatggcccttctggaggaaatgctccagcagaggaccatttgtcagccaattagcagtgtgaatttggggagaaagtaattcctttttcattactgctttagtgttggtctattaatgggataaaagataaataaataatttttaaaaaatttaatctctcaggatgaaaatccaaagatcctactaaaggagaatggaaaaggaagtctgaggtaaggtcatttccagtgtctctaacaaataaactaaaatgaaagatcagttggtccaaagaggtggaaccttgggagccccaggattcagaattcttgagagctttctggctgcaacagcctttaaagctctgcagatgtctgatcagagtagattgtccctcttcgcagagtgacctaacacgactattacctcagtggaagccaaggaaattcaccattgaactcttggaattatcgtcctgatgcatccccctggaaataataatagggaaaaaggaagtaccaaaatcaattggaaaatatttgtttttctatcctcatgttcccacattcagttaacatgattctaatacctctgataaacttcaagataggaaaattatcaaaaaataaattgttttaatactgaatatgacaatgttatgttagcataataatagttctaagaagtcctaaattttaaaaagtctacatattttaaatgagtaatttttattgtacacaagtgttccactggacatactttgagaaatattgccctaagtaataaaaaatgacatgaatcttcctttaagcaaaaatagacctagggtttgcctgctagatttctgtttactcaggatttcctctgtctttctaccgtgtcttgtgatttataatgaaaaatgagttcttcttctaccaaaaatcaacttaaattagtgaatgaaattataaaggtgtttagtaacttagttttgacagaggtgaaagctaaattaaaatgctaaatgttagtggaaagggaaatgtggtcaacgtacacaggacatgacaagaactggactaaaaggtgtcctcccggtttacagcccattatattaacctcgcacacagtcccagccacaggcccacttctcttcatgattctccaaccctcctgttcatcctctccattatcctatactcttggaactcctgacttctcaaacatttcccttttccccaccttttttttggattttactttcctggatagatgttctgataatgaacagttgctccccctcaaacgtcaaccaccaccccaccaccctgttcttggattcggatcctgtccttaatgttaagattcacacttcccacttctcttgattcatcagaagaaatcaaacagatcacccagactctaaactgctcatctatacctcattcttcacactagattcactgactcatcgtctctttaataaatgctcctatatttatgttcttatatcactagggaattacacaaatgaacattgggacataagaccttcaaataaaaagtgcttatattctgtaagtaaattttgtgttactgaaaatgaggtcctcttatttattgtagtttctaacatacatggacagaggggaggggtggaaatgaatgggcagcttttccccaattatgaaaaatacaaatcactaattcaagaatttaaaaaactcaggtattctttagaaaaggtggggaaagggaagtaatgagcaacagaactcaaggaaacaaactgtggggaaaatagataatttagcataaccttacagaaatccaaatcaccttacaatctctctctctctctctgtctctctctctctctgtctgcagtcaatctatagtcttctttttctatctagagacaagatttggggtaccacgaatattttttattttagtctcatgatttttatgtatatgatgcttcctgccaaatagttgagccattagaattacacatctagcctgtaacactgtgtgttgtcctttagttgaccgtctgcaccaatgaaaggcactgttgttaagacatgtccctttgcccttgtggttaccattttactccaaacgatttccaagggtgaagctattatattacttcagctactgtattcaccctattgagtcatattttggctacaagcctaataagaggcagagtcaatactgaattcagatgaatttatgcatctatattttttaaagatacttttataacaaggaactactgcctattaaaagcaatgtaattgacaattatgatatcaaaataatgtaacacactggtcacttgatttaagtagcacattaagagaaaaaacattcttatgtaaatttcttttaatctgtcattgattttaacataaattcagatatgtattttggtggcaaaaatttggcctttgtatgtagtatgtgttataagtaaaaatgggatttgtataaaatcaaatatttaaaataaaaaataacatttttgattaaaaactatgcaaaccttcaaaattataataatgtaataaacacaaagataaaacaaaaacaaataaaatatactatactagaaactaaaaatacatgtcatgtgcttcatatgatgctgcttctatagagaaagtaagttctaattctcaagtattctactttctacaaatctcaaagaacttcaacacttgagacaaatgttttaatttttatttgcacagtaaacacaaactgaagaaatgtgtctctctctaagcatttgcattgaatagtccttggaataactgcttctatcttggtgtgttaccttggacaattcattttaaatttctggtctcagtttcttcatttatacagtaaaaaataacaggaagcatagagttcagtggtttttatggtttcttcaagatgcttcagaaacagcaagaaagaaattgaattttatttctattaaatattggtcccacacagggataccatgaaaaactgagttagggttttaacagatcctcccaaaaaaaacattttaagtaactatacaatctaagtagaaatagtatgcttactatgcaaacacagcctcaagacaagtcccttggccaaaacatacaggttgttgcctccaaatctcttcaatatagaaattctcaagccaccactaaatccactacttcattttttaaagttttgttttgttcaatttttttaatgactagtataaccaaaagaaaatgggttttgtggttagacaaattggggttcaaatccccagtctgctttctatgaaaccctggacaggtttttcaatatttcagagctttggttttctcattttaaaacagataataatacctaccttacaatgtcactggggtaataaataaaatactgcatataactcaaatgttaaagattggatggctttctttggactataaactttctgataactccccagttctttgagtggcacccctaagaattatagtaattcttgaggcaattacacacattgttatcctttgcctttgtgcctctatcttcctcagatattacctctgcttcactccacatgaaaatcaatattcttttagttttcacaggcattcataagtaaaaatgtgattacataaggtagttcatatatttgtctctcttcctagtttcctctccctatgtgcctttccattcatttctccaggattggcctgacaattctaaatttttcttcctcattatgaagaacaatttcttttgatgtaaagctttggcaatagatatcattcgtatcctgatggtagagacctcacctaattcacatattgcccttgtattattttcaacagctacagaaaacatatttctagaaagttttagcattgtgattatctcctcaatatttattccatcaatttttttatatttagtagtcgtgctgtttaggtttagttaagccttattactcaaagtgtgttccaaaggccatccactgtcaacatcacctggaaactcattaaaaaagcaaaatctcagggtccattccagaataatgagctcgagccacaggtaacttcatctctcttgccacacaatcttcaaaagttcacacaactcaagcctaagccaatcacacttataaattcctagtctcaggaatcagtttaagatgtgtaaaaccttaagactgtccaatcagtgatgcttatgatttgtgttttgtgtttgtaaacacagactttttctttccccaccacaccatccctcaaatatgcataaggaagtatggctctctggttgctctatgaagccacattgtaatagtgaagcaacaagcctgaggacaaatcttatataaagagggtctcataagtctcagagaaatggaaacaactgtgatgaactgccctctgaagctcattctacctttccacaacataaccaaactaattcagattattttttgaggctagctggaaaaactatggcctataggccaaatctagtttgtattgttgtaatctaaagaattatttttaattctaaaaagatgtagaaagacatgagaagagttcaaaaagatgacagagtaggaagcaccagaaatctgttcccccacctggaaaacaattgcattgacagaatttgtctaatataactagtttggaactgtagaatctattgaagaattataacttccagaataaggcttgaagacaaattgctgttgatttgggtctgtttcagctcttatcacagtagcaggtaccaatcccccaccctcagccccacagcaggcagttgtgtacctattcctgaatcaacaagtacagagcttgtaggagccagagtgagcaaaaagtgtcccatcctccaaatatcaggaatctgtgctctgattactgattgctgcttctattacagaggtgcagacaaaggggtaggtggccattattattgcatctcccccagttgctacaagcccttcaatcctccagctgaaaggacttccaggggatttaaagggccaacaccctttctctcctctcacttttccctttttccttttttgggagccagatattaaggaccaggacattcaaaaacaactgcatatatgggggaagtagaaggtgaccatgcatgcccagggaaaggcacagactcagaaaagacctgagaagaccttaagttcacacctcaggcttatccttagcacacagactgccttcaacaatcaaaaaataaaaataaaaataaaactaacaaaattaacaaaaaaacggcaaactctagagaaggaagagaatctgatttaaagagttagcacattattagattcaaatgtccagttttctacaaaaaatcatgggcacataaagaaacaggaaaatatggcccattcaaagaataaatcaatcaatcaacagaaactgtccctgaaaaggggctaatggcagatttactagacaaacactttaaaacaataaagatagtcaaaaaactaaaggagatgtgcagaaagtcaagaaaatgatgagtgaacaaaatggaaatatcaatgaagagttaaataacctaaaaaaaaaacaaaaagaaattctggagctgaatattataataattgaaatgaaaatttccctagaggtattcaaaggcagatttgaacagacagaaaaaggaatcagtaaacataaggctaggacaatgaaattactaagtcagacaaacagaaagaaaaaagattgaggaaaagtgaacggagcctaaggaacctatagtacagcattaagcagactaacatatgtattgtgggagtcccaggggaagagagaaagaaaacagctgagaaaatatttgaagaaataatagttaaaaacttctcaaatttgatgaaagacataaatatgaatataaacatccaagaagctcaataaactccaagtatggtgaactcaaaaagatccacatcaagacacatataagcaaacttttgaaagacaaataatcttgaaagtagcaagagagaagcaattgatcatatataagggatgcccaataagataaccagcagatttcttatggggaactttgaaggccagaggcagtgggctaccactttcaaagtactaaaagaaaaaactgtcagccaagaattacatatatggcaaaactgtctttcaaaattgagggaataatgagaacattcccagataaaaaaaagccaagggagttcattaccactagacctatgctataagagatgctcaagggagtcctacagggtgaagtgaaaggccagtagacattaactcaaagccatatgaagaaataaagatctcaataaagataaatacatgagaaattataaaagctagtactattgcaacaatgatttgtaacttcactttttgttctctacagtaacaatatttaaaagacatacttttaaaaaaattattagtctaacatctaatattactgtaacttttatttgcaacaactacacattctgttttctacattttttaagagagtaatgcatttaaaataagtaactatgttttggagcacacaatgtataaagatataatttggtgacaagaactaaaagggagggaaacatgagtggtaaagaagcagagtttttgtatatgaatgaagttaaactgatataaattcaaattagactatcacaactttagtctattaaatgtaatccccaagttaatcatgaaggaaataaatacagaatatacaaaagaaaatgagagaataatttaaacataagaatttaaatgttttactacaaaaaaaattaaacagaaaagaagacaataatgcaggaagtgagggacaaaaccaaaaggcatgtagaaaacatataacaaatgacagaaatatatgatacaaacatatatggcatggtgaaaacaaatagcaaaatgacagaaataagtcccttctaattagtaataatgttaaatgtaaatgtattaaactcttcgtacaaaagacagattgacagaatttctaaacttttatgatcaaactatatgctgtttataaaagactcactcgttttagatcttaagacaaaagagactgaaagtgaaaggatgggaaaagatacttcatataactagtaactaaaagagactaaatgtggccatgttaatattggacaaaatagacaaaatgagacaaagcaaaaatattatatattaataaaagttttaatacaataagaaaatataacaattataaacatttatgcacctaataacaggctttcaaaatatatgatgcaaaaactgacagaatttaaaggagagatataaagttctacatattttaataacttactctcaagactggatagaacaaccaggaaaaaaagtaaataaaagaaataacttaaacaataaaataagccaactagatgtaatagacagatgcagaacactccactcaacaaccacaatatacacatttttctcaagtgcacctggaacattttctgggatagaccatatgttaagccacaaattaagtttatatatacatatatgtgtgtgtgtgtgtgtatgtatatatacatatatatatatataaaaaattcttttttcttgagatggagtcttactctgttacccaggctggagtgcaatggtgcaaactcagctcactgcaacctccgcctcctgggttcaagtaattcacctgcctcagcctcccacgtagctgggattacaggcacctgccaccctgcctggctaatttttgtatttttagtagagacggtgtttcctcatgttggccaggctggtctcaaactcccaacctcaggtgatctgcccaccttggcctcccaaagtgctgggattacaggcatgagccactgtgcctggcccaagattcaatatattttaaaggttgataatatacaaagaatcttctccaaccacagcaggataatcttagaaatcaataaaaagtaaaacagaaaaattcataaatttttggatattaaacaatgcactcaactcataatattgttgttaatcattattaaacaagaatggatcaaagaagaaatcagaagggaaattagaaaatacctagagatggcaaaaacaaaaaccttacatcaaaatttacagcaaaagtggtgctgagggaaaaatttatacctataaatgcttgtatttgaaaaaacaaagatttcaaataaacaacctacctttacaacttaagaaactagaagatagtatagggaggagccaagatggcagaataggaaccgctccaatctacagctcccagcctgagcgacgcagaagacaggtgatttctgcatttccatctgaggtatcgggttcatctcgctagggagtgccaaacagtgggcgcaggtcagtgggtgcgcgcaccgtgccggagccgaagcagggcgaggcattgcctcactcgggaagcgcaaggggtcagggagttccctttccgagtcaaagaaaggggtgatggacggcacctggaaaatcgggtcactcccacccgaatactgcgcttttccaacggacttaaaaaagcggcgcacaatgagattatatcctgcacctggctcggagggtcctagcccacggagtctcgctgattgctagcacagcagtctgagatcaaactgcaaggcggcagcgaggctgggggaggggcgcccgccattgcccaggcttgctgaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcaggggttctcccagtacgcagctggagatctgagaacgggcagactgcctcctcaagtgggtccctgacccctgacccctgagcagcctaactgggaggcaccctccagcaggggcacactgacacctcacactgcagggtactccaacagacctgcagctgagggtcctgtctgttagaaggaaaactaacaaacagaaaggacatccaaaccaaaaacccatctgtacatcaccatcatcaaagaccaaaagtagataaaaccacaaagatggggaaaaaacagaacagaagaaatggaaactctaaaaatcagagcgcctctcctcctccaaaggaacgcagctcctcaccagcagcagaacaaagctggacagagaatgactttgacgagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaagactcgagaactacatgaagaatgcagaagcctcaggagccgatgcgatcaactggaagaaagggtatcagcaatggaagaggaaatgaatgaaatgaagtgagaaggaaagtttagagaaaaaagaataaaaagaaacgagcaaagcctccaagaaatatgggactatgtgaaaagaccaaatctacgtctgattggtgtacctgaaagtgatggggagaatggaaccaagttggaaaacactctgcaggatattatccaggagaatttccccaatctagcaaggcaggccaacgttcagattcaggaaatacagagagcgccacaaagatactcctcgagaagagcaactccaagacacataattgtcagattcaccaaagttgaaatgaaggaaaaaatgttaaaggcagccagagagaaagttcgggttaccctcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagtttttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaataaccagctaacatcataatgacaggatcaaattcacacataacactattaattttaaatgtaaatggactaaatgctccaattaaaagacacagactggcaaattggataaagagtcaagacccatcagtgtgctgtattcaggaagcccatctcacgtgcagagacacacatacgctcaaaataaagggatggaggaagatctaccaagcaaatggacaacaaaaaaaggcaggggttgcaatcctagtctctgataaaacagaatttaaaccaacaaagatcaaaagagacaaagaaggccattacataatggtaaagggatcaattcaacaagaagagctaactatcctaaatatatatgcacccaatacaggagcacgaagattcataaagcaagtcctgagtgacctacaaatatacttagactcccacacattaataatgggagactttaacaccccactgtcaacattagacagatcaacaagacagaaagtcaacaaggatacccaggaattgaactcagctctgcaccaagcggacctaatagacatctacagaactctccaccccaaatcaacagaatatacatttttttcagcaccacaccacacctattccaaaattgaccacttacttggaagtaaagctctcctcagcaaatgtaaaagaacagaaattataacaaactatctctcagaccacagtgcaatcagactagaactcaggataaagaatctcactcaaaaccgctcaactacatggaaactgaacaacctgctcctgaatgactactgggtacataacaaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacatcacaattaaaagaactagaaaagcaagagcaaacacattcaaaagcgagcagaaggcaagaaataactaaaatcagagcagaactgaaggaaatagagacacaaaaaacccttcaaaaagttaatgaatccaggagctgtttttttgaaaggatcaacaaaattgatagaccactagcaagactaataaagacaaaaagagagaagaatcaaatagatgcaataaaaaatgataaaggggatatcaccaccaatcccacagaaatacaaactaccatcagagaatactacaaacacctctacgcaaataaactagaaaatctagaagaaatggttaaattcctcgacacatacactctcccaagactaaacaaggaagaagttgaatctctgaatagaccaataacaggagctgaaattgtggcaataatcaatagcttaccaacaaaaaagagtccaggaccagatggattcacagccgaattctaccagaggtacaaggaggaactggtacaattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaactgaatccagcagcacatccaaaagcttatccaccatgatcaagtgggcttcatccctgggatgcaaggctggttcaatatacgcaaatcaatacatgtaatccagcatataaacagagccaaagacaaaaaccacatgattatctcaatagatgcagaaaaggcctttgacaaaattcaacaacccttcatgctaaaaaatctcaataaattagctattgatgggacatatttcaaaataacaagagctatctatgacaaacccacagccaatatcatactgaatgggcaaaaactggaagcattccctttgaaaactggcacaagacagggatgccctctctcaccactcctattcaacgtagtgttggaagtgctggccagggcaattaggcgggagaaggaagtaaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatgtggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagatcagagccctcagaaataacgccgcatatctacaactatctgatctttgacaaacctgagaaaaacaagcagtagggaaaggattccctatttaataaatggtgctgggaaaactggctagccatatgtagaaagctgaaactggatcccttccttacaccttatacaaaaatcaattcaagatggattaaagacttaaacgttagacctaaaaccacagaaaccctagaagaaaacctaggcattaccattcaggacataggcatgggcaaggacttcatgtctaaaacaccaaaagcaatggcaacaaaagacaaaattgacaaatgggatctaattaaactaaagagcttctgtacagcaaaagaaactaccatcagagtgaacaggcaacctacaaaatgggagaaaattttcacaacctactcatctgacaaagggctgatatccagaatctacaatgaactcaaacaaatttacaagaaaaaaacaaacaaccccatcaaaaagtgggcaaaggacatgaatagacacttctcaaaagaaggcatttatgcagccaaaaaacacatgaaaaaatgctcaccatcactggccatcagagaaatgcaaatcaaaaccacagtgagataccatctcacaccagttagaatggctatcattaaaaattcaggaaacaacaggtgctggagaggatgtggagaaataggaacacttttacactgttggagggactgtaaactagtactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaagtgatcagttcatgtcctttgtagggacatggatgaaattggaaatcatcattctcagtaaactatggcaagaacaaaaaaccaaacaccgcatattctcactcataggtgggaattgaacaatgagatcacatggacacaggaaggggaacatcacactctggggactgttgtggggtgggtggggggggggagggatagcattgggagatatacctaatgctagatgacaagttagtgggtgcagcacaccagcatggcacatgtatacatatgtaactaacctgcgcaatgtgcacatgtaccctaaaacttatagtataataaaaaaaaatttaaaaaaaaagaaactagaaaaagacgaacaaactaagctcaaacctagcaaaaggaagaaaataaaaaagattagatcggagataattaaaatagataatagaaaaaaaatagagaaaaccaatgaaaccaaaagttgattatttgaaaagatataaaaagatagactaagaaaaagagagaaggatcaaattactaaaaccagaaatgaaagtgtaaatgttaataccaactctacaaaagtaaaaaggatttataagaaagtactataaacaactgtacatcaggaaattggataacctagatgaaatggaccaattcctggcaacacaaaacctactaagactaaattatgaagaaataaaacatataaatagacctgtaactactaaggaaattgaattagtaatcaaaaatctcctgacaaagaaaaaccctgaacctgatgtttacagtagtgaattctaccaaacattttttaaaaaactaataccagctcttctcaaacttgtccaaaaaattttccccctcaatcaacaactagaatttcccccaaaatcaaggatggggaagttctcacaagggcatgcctcagatcaccccaaaatttggccagttggaattctaaagaaagaagcattaaatgccaggctgataaattcaaagcatttattaggggaacttatgtacagagagctgcagcaatcttcactgcagacagtgagaggaaaggggtattctacttgagtatatgtccaaagcatggagatcaggatatggagtttatatgagggtttaaggaatttggctcagggtcaagactagcttctttcagtgtttttggcaacatcctagatacttctattagtgcctaggaatactctaggcttctggttgtattcaagcctgctggagaaaacctgaagctgtgtggatcacaaagtggtccaggttccctgtcatttgcaatcaggacacaaaaaggaagtgggaaggaagaagaattgggggattccacaaaactgaagaggaaggaacacttcctaactaatttcatgaggccagcattactttgataccaaagtcagaccaagagactacaacactgtagactaatatcccttatgaacactgatgcaaaacttctcaacaaaatatgttcaaactgaattcagcagcatgttaaaaggattatatgtcatgccaagtgggatttattcctgggatgcaaggatggttcaacatactaaaatcaatcaatatactacatcacattaacaaaatgaagaaaaaatgatcatttcaattgatacagaaaaagaatttgacaaaattcaacagcatttcatgataaaaataataaactaggaatagaagaaaattaataaacataataaaaactatgtatgaaacctaatgaaagctatgtatgaaaactccacaaaaaacatcatactcaatggtgaaaaaatgaaagattttcctctaagatctgcaacaaggcaaagatgttcaacttcaccacttctatccaacatagtactgaaagttccagccagagcaattaggtaagaaaataaaataaaagacatacaaatggaaaaattaagaagtgagattatctctgcccacagatggtactacaggactttttagagcacatggaaaaaaaatgaaattaaaagataaaaataaggaatataaactgtatttctcaacataaactccaccaaataaaagtcacttttgtaaatgataataatagccatttagtccatccttatatcactgagggcccaaggaatttaaccatgtaaatgccttcatttttcaactattaactagagaaaagtaaaggccttttaaagatttattaataataagacataaaaagaagtcagaaggggccaaatcaggactgtcaggtggatgcctcatgatttcctatcaaaactctcacaaaattgtccttgtttgataagaagaatgagtagaagcattgttgtgatgatgaaggactctctgataaagatttcctgggtgtttctctgcttaatctttggctaaccttatccaaaaaaactctcaaaataagcagatgttattgttctttgaccctccagaaagtcaacaagcaaaattccttaaacagtcccaaaaaacattgtcatggccctcgctcttgactgacctgcttttgccttaactggatcacttccatttcttgaaagtcattgttttgattgtgctatgtcttcaggatcatactgggaaagtcatgtttcacctcctgttataattatttgaaggaatccttcaagaccttgatcccacacattttaaatttccattgaaagctctgcttttgtctgcagctgatctgagtgcaacagttttggtacccattaagtggaaagttgctcacctataattttgggggtcagaattgtgtaagctgaaccaactgagatttccatggagttggctattgctgtatcctcttcaattagggcaaaggcaagatgaattgtttttctcataaattggtgtggatggtctgccgctgaaggcttcttcttgaacatcattttgtctcttcttcaaactagttgttcatttgtaaattgctaatttccttgggacaccgttcctgtaaacttttctaaagcatcagtgatttcaccattcttccaaccaagtttcaccataaatttgacatttattcttgcttcaatttcagcagcattcatgttgctctgataggagctttttacaaatttatcttatccccttagcacctcagactagagcctgttcaggcacattataacaaggtagtttattttggtggaaaagtattttgaaaaccatgcgtagtttttccatcatgtgcattttctatgaactttttgaagacacatcatgtgatcttatatttacaaaaccataaaaattccacacccccaaaaatgctgtcagaataaatgaatacagaaaagaagaatacgaggtcaatacatgaaaatcagttgcatttctatatactaacaagaaataatctgaaaagaaaattattttttaaattccatttacaatagcttcaaaaagagtaaaatacttgggaattaatttaaccaatgaagtgaaagacttttacaataaaaactacaaaatattgcttaaaaaattagagaagacataaataaatggaaatacatgccatgttcatggggcagaggacaatattgttaagctatcaatactacccaagcaatctacagattcaatgtaatccctatcaaaatttcactgatatttttgcagaattagaaaactcttttctaaaattcatgtggaatctcagagggccttgaatagccaaaacaatcttctaaaagaagaacaaagcttgaggactcacgctcatgtcctggtttcaaaacttactacaaaactatagtaatctaaacagtgtggtactggcataaaaacaaacatataaatgaatagaatagaataaaatagagagcccagaaataaactcttattatatatgagtcaaatgctatatatatgagaccctataaatataaaggtgacaagatcattcaatagagggaagacagttttttcacaaatagtgcttataaaactggatatccacatgcaaaaaatgaagttggatctctcctaacactgtatttacttgtggttagttagccagattaacttaaaatagatcaaatacctaaatgtaaggcctaaagctagaaaattcttagaagaaaactgagcaaaagctttataacactggatttgacagcaatttcttggatatgacaccaaagtcacagacaacaaaaacaacaatggacaaacttaacttcattgaaatttaaaatttttgtgcatcaaaagacaatatcaacagagtaaaaaagaaaaccacaaaatgggagaaaatagttgcaaatcatatatatgataaggggctaatatccagagtatatagagacatccttaaactcaacaacaacaaaaaaccctgattcaaaaatggacaaaggacttgaagaggcatttctcaaaaaaaaaaaaagacatgaaatggtcaataagcacatgaaaagatactcaacatcactcatcattagagaaatgcaaatgaaaactacaatgaattaccaattcatactcattaggaagtctattatcaaaaagaaaaaaaaaacaataattggcaaggtcttagaaaaagcgtaaccctcatgcaccattgaaaggaacataaaatgttacagatgctatgggaaacagtgtggcagttcctcaaaaaattaaaaatagaattactatgtgatccagaaattcgtcttctgggtatatactgaaaagaactgaaaacaaggtcttgaagagatatttgtacacctatgttagtagcagtgttattcactatagctaacatgtggaagcagcccaactgttcatggacagatgaatgagtaagcaaactgtgatctataagtaaaatggaatattattcagccctgtaatgaaattctgacttatgctacagcctagatgaacctcgaggacattacgataagtgaaataagccagtcacaaaaagaaatatactttatgattccacttatatgaggtccttagaataatgagttatagagacagaaaatagaatggtagtttccagggtcttggagatgagggaaaagggaagtattgtttaatgggtatggagtttcaattttacaagatgaaaagacttatgaagatggatagtggtgatggttatataacattttgaatgtattttgtaccactgaactgcatatttaaaaatagttaagatggtgaattttatgtgtattttactacaatttaagaaaatgaaagaaggtataggaagagcaaaagatgaaggagaaggaggaggaggaggaagaggtggggaagaggagggggggaggaggaggagcgggaggaggaggaggaggaacaaaacatatgcagcccacaaagcctaaaatatttaccatctagccctttatggagaaagtgccctcatcctcaagccaaccaaagcatccaaatggatgtggaaagtaaccattctcacctcttcatgcacattaatagcctggcacttagcaggcactcaattaatattagcctttatcagcaacctcctgctaaattctttttattctaagattatgtggtacaatatataaaattaatgagaaatatgcaaattttatttaaaataatactgcgttatgcctgtaattctttaaacccatgaagagggtatgttgtgctgtataatggttaacagcactagttctagaactagattgcatgggacccagtcctagcctaccactcactaactgagagactgtggacaagttatttgacctccctttgtctcattttcctcttctaaactggaagtaatattaagagtacctatctcattgggctgacattatggttaagtgtaaaatgcttccaacagtgcctgacacatggcaaaacaaattaataaaggttatctgtatcatatctctgcttttcaattatttaaattgtttaatatcaataactgtacaataatacaatcattattgtaatatggagatgtataattgttcagcaaatgttcacatatgtagggaataaaaaacaaattgtttccaactacaaactttcttttactgatcactgatattcccacttggtgcttttagcacattgttcttgggtggtgatggtttgaagttggtaaaaaacattgtttgttgcctacaagttctcaaattgtaggcactgggaaaagaacaagaaagaagacagaaaggtacctgaagaaattgctgttctgatttctccattgttggtttaaatgctaatctgccacttctgggaacaagaaatatccccaagagtattctttttgacctttcttaacttcctctcctttctttccttctgactttatttttagatgaatatcaaacaggaaatccactccactaagaaatggtgaattttctagctagagatcagagggtggagcccactgggaaatcagtaatggagatcagaccaaagagctgggccaaggaaggatggatagatacttgtaaaacaagaggccatttttgtgtctttttttcccctactagagatgaaactagcagcttccatttatgcccaaggcacaagtttttaaaaacagatcagttgatttaaggcaaaattcaaatcaaaacactggcaagacctacagaacagatatagccacagaactgttctaatgccccaacaccggaaggatgagggtgtgtagggtactgaaagacataacaatgatttgccacttactgctaagtgttgccaaatgtgctttaagtatctcatgtactggaaatacactgcaaattacattccttatgttgtgaataggaacagaagctttttctttctttcctgtttatattatcgatcactgcacatccaaatccacctcttccgtcttgtaagaaattgatatataggatgtattttgtaaaactttgaatcttttggatttgaagctgtatgaagttacacagagtgatcttcctggtgagcctctaagcctgaatgtaatttcaacttcttaagccaggaaatagcaaatcttgtacaactactaacatttttgcaaattattttaagagtctcgaagatagcattatatattaagttgattttggatcaaataatcaactggaaacttaattctacaggtcagtactactaagtctctagcactggtttctgtagtgtaggagatctggaaacggacttctaaattaaaagatcgacatctttattgaagcttgcacataacaaggtacaaaactattatacacattaccaaactggcaaactcacataacaagtgtaaaaacgggcctgctgatcataaaattccttttcccagaaataattaacaaattgttaccactagtaaagctttcttaaagttttaatctatcacaagtcatcaaaaattaaggtgtgtttttagccaagtaatatgtttagagtaacaaaatgaaatagtacaaaagattaaaaatatctgtatatgagtcccttccattccagacagtgtcatagagaaagccattactaatagtttattgtatcctgctcaaaatcttttatacaatacaggaaaatatatcttttctttttaatgcaaatgaaagttttctgcactttgctgttgcagccttgacctcccaggctcaggtgatcttctcccaccccagccttccaagtagctgggactatagagacatgccaccatacccagctaacttttttattttttgtagaaacatggtcttcccatgttgcccagcctggtcttgaactcctgggctcaagagatcctcctgcctcagcttcccaaagtaccaggattacaggcatgagccaccacacctggctgcttttttacttaacatttttgaataaatttccatctgttcctagtggccatacaatcttttcaacgcaatgatgaaatcctaaaatctgtataccataacacaggcacaaagtgttactgtcattcagccacgtttctcagtgcttcttctacctatgttaatatttgtttggtaatagaatggtcaatcagatatgtatgagaaacactcagttaaaaggtaaacagccttcttccttgcctgacattccagattcctgaatgtgctgactttaaccatgactcattaaagggcttatgtagcatattatatttcacacaataatttaaccaaggagttttcttgctgaggagcatcttttgagattggtatgccaaagaacacactttggagactgctgagttacagcatctcacaaccctgtcagataggttgtattatgctcatttacaaattaaggatgctgagacttagaaagcttaagtgactttcctgaagtttccagctggtgacagaattggcatcaatacaccaaatctatcctcttctccccattccacacacaactcgtcatccttttagcatcactaggcgctagtgatattaaaaaaggttccttgtgtttaacagaagaggctgagcttacaaacattttgacagtatagtctggatatcaacagggccaaaaacatactacatataaaatgtgcaacaggatttcacagaagcaagaaaagattgtggacataggagtccaggacagggtgatctatttgacttagagcatgttacctgtgccccctttgcacttagtttctttggcacctttctggtagcattcctatgcagataaaatgaaaaggcattttcacaaagcctgacctctcaatcaatgttgattcttgttactgtctccaaaattagtttctaatttccctccaccccaactattacattatttggaaatttcaccattctgcagaaatgtgtatattctttctccatgattcacacaaacctctagcttcctggaattcaaaaatgataaatctttaaaaaatatttttctaaaataaaaatacttttggatatttgtaaatcaaaaagtataaatatttttagaataactacaaaccttgtaaattttgctcataggttagaaaatggaaatcataagttaaagcctgtcttacaaacaaataccacaggcttcaaataatgaggatcggagaaacttacaggcatgaggtcaggaaggggcacggaggaagtacaagggagatactaacttcacccctctcctactgagtcgagatggaaagtgaacagtggatgtgaggaaatagggaggtgtttataggaaaaggcaacagaatatagggtattattattcccccacaacttccctatcagtgtcagaattcacctgtagtttttgctcttgaatcatatccacagtcccagacctacagaataacaaaatcctgagatgcttactttaacttgcatcctaaattgttagcaacttgacttacctcttgatatttcctgaatttctgacaatgttccctcttccttgccatagttatctatgacctctttgctttggcagagaaaatgccatttcttgaactattgggcctcttgccctagtaagatataatgtttccctttagtaaatttcaataatagcatgttgtaatgtatcataagcagatgatatacattactgcatacttcctagttccttgcttgttttatacaagacatctcccattactgtcattcctgccttatctaggcatcttaaatgaagaaaccaaattgcagttcacacaagtttttagttaccaaattaattttctgaccctgatattgtagccaaatttttatgatgagatagttgaaaaaagatttttaaagatccatttcttattttggtaattgcaccgaacacttatgctccagttcacattctatcagcttcacttcttatgctaactactgtggtagcaacagttctacgcaggcttcacccactttcacatgaatgcaatctgacaggccttcactctgaaccccttagacaatgagggaaggaagccaaggcttcctctcttcttccccctatcagttggttctgagatatcttatatagtttctcagaaggccccatgggattgacaaacctgttcctctttggtgtgacttgataactcactcttaccttggcttttccttcttcctgtttcactcccttgtcctcatcttctgctctctaaaattacattcccaaataaacaattctcaataggtctttgccttaggctctgtttttgagggcaatctggtgtattgattagggtccagcagggaaacagaaaccacaccagtaatttaaacgagaaaatttaatataaagaattattaacttgtagcagaggattaactacaaaggggtaagaaaagtttaaagaacatggcaaaagcagataatgaatcagctacaacatccaggctaagacaaggtatccaaagagggaatcatcttgaaagagagctgtccccaaggcttagagtcagacctcaccagatggctgaggagctagctggaagcagcctgttggggtgcccaaaaaactcactaggcagctgctctctgaggcaacaataagattctctgggaagctgcccattgaggttctaacaagactcgctgggaaaccacttgctaaggtgttgctgaaactcactgagaagctgctggagtacactgatgagactctctgggagtctcatcagatcaacagtgctatgggcaacactgacccagaagccaccctttggggtacactgccccactgaagtgctggcaaaacaagcagaatagtgagcatccctgggtactggctcccatacaccgcaggaacaagaaggaaaaaacacgctgaaaggactgaggcaaactcctttctcctacagtgtccttccactcctcttaccaacaaagcttaactttgtgccaggtagctaagaagaaatgtttactggttccagctgcggcagtacaaagcagggcaaggaaggatggactgggcttagacagcattccactgactgtggccaaaacgttatttcccccaaccaattaccaaagctagtagtagtcagcacaggaaaactcagccatgggcagcagttgcctccctccagcatctctcaaaccatgttactctcacctgctcttctctccttttatcctccctggcttcccaactcacagcacctacctgagccttccttgcttccatgatggacattttctcatacatcagctcctcatatccacgactgtgtgtaagaaatgctcttgtggctcggcactgtcccaaaagaccaacacaagccaggccagccaactagcttctcctccaaggagaggcattcaacacctcccttcatctcatgcgttcattcaggaatagcttttgcacagaaggcactaaccagatcctttgagtccaaagtgagcaggtgatctcatgatgtcaggtttgtttgttttttttttccagacagacagacaaattagtgcccaaattctggctcttccgtttgttaattgtctggtcataatcaaatatttagacttttccacatcactctcttctgtaaaatgtagataaggtttgctttataaggttattttgagaataagaaaagaaacaagaagcattcattcatccaataaatattagtatttgttgagtacctactgtgtgtcagaaattttcctaaacattaagaaaaaaggtaatgtaaataaccatctggttcgtggtagaagcttactataaaaagatttccactcctgtccttctttttatgactgtgaacattgtctattgtaaatgaacaacaaatttagttatcattatttctcttttttgtgtttctttgttttatagaaagcataagagaaaaaatctttatagattgcatttatacactgaaattattagggcttattcctatgagaaaactcaggtggcttttttttaaataagtatgtctcaaatattcattattgatctgaaaaacacataagagaaaaatatctcagatgtgctactgggtgtgatcaagatagctgtcagtgagtaaatatactctctactgcatccattttaaataatagtatacatggcaaatacctttgacattcttagtatgtcaaagatttttgtaggcatgaaactaacattttacatatgcggatggaaaggttaaatcattttcccagtcactaatccatcagtgacataattaccaaccaaaccttaggcttctggttccctggtcctcctgcctccttttctccttcaaaaaacattcacccacaatgatatctacttgccttttactctaattttaagaaagtacactggaaaaaaaagtattactaacattttccttcaaatcaaattaatcagaaaataaaattaaagcacatttatttagcagaaagctactctttccattaatgagaattttattaaatataataaaacatttcaggcaatttctttcttcctggttttttttttcctcttcctttttcagatttattgaaaagcatttttattagtgcaataataggctccgggacatgcaattatattgagatgctgacactttcctgttagttgcagcctttggcctgaggccaaacactgaacccaagcatatgagtttctctgcaagcagccctggcatggcactcgcatgcatttgtccttacagcaacctccagttttcaaccactacagagagaattaactaatttttccctcctattacaactgatccaaagagatacttccatctctttttagagaaacccaaaagttccttatgaaatttttgtagaatgcagagttagagacagattagaaactttcaacttctgtttcatatggggaaataccataaagggtttcattactttatgaggcatttacacacatgaaatgcaaatgcttgtgcctttgtcatgagttttctttatagctttcactcctgtatattttttaattgtaaatcctcccctttccaagctctgagccaaagcatttcagaataaaactgtagatatcaactataaataaaatacagattcaaacctctgcaactttttaaaatttgtaaggcaggaataaaccatcctttaaaaaggaaaaaagaagccaccagaaaatgcttctgaattcactcccactttctatgtaaaggcactgagtttcaatctttaaggagttaaatctcttatctggattcagtgccatggaacttccccacatatcccagtctctttcataaagcattgtatacgttattagaatacccatgtaaaaccttaaaaactttgtttttaagttacatacacaccatacatacacacacacacacatacacacacacacaactaaactacgccctctaaaaatgcttccggcctgactgtgaacaaaaacaaaggggtctctgctacccctagctctgccctgtgactgttccagcaaagcttggtagtgttttaggcatcacttcctcagcagggaagtggagtttagagatattaatccttgtgaactgaatttggtgtgagaaactcctgggggaaatcccaaacacttgtgctgcctttgaactacagtcccccaacactgactatatctccccttcctttcctgccccctaggatcatccttgctttcctgggcccatttcagtcttattggtttggaatctggactgcagcgttttcttttccaagtcctggctgggctccttggaagcagagtgcccccacccagccataaagattattgtgagcactttgaaactgatgccaaaccaaatcaagcccagtggacacagtcccttgcacactgactggattcctgcacgccctcctttgggttggccctacagcctggtgccaggccaatgaaagctcagtcctgcccacacccctccctgccacactccagagatcccacagtgcctctgagcttgtctcaggggtgcgaaagtcagagatgatcagttttccattcttagaaatgcataaagcaacaaaagtcactaggaatctctgaggctcagagaagaagtgaggttaggaaaaactgaagctgtagccagaatagccttttcaaaagagaaggggaattatagtgaactggctggtgatactttattgacctctaaattaacttcatcttagcatcgtaaagacctagcatggagaacgaaaactgcttgggtgacaggaatagctaagtgcttggttaacgggtaaacaagtgagggaggctacaggtccacgtctctcccacatacagagtctgaggagtcaaattcccacactgagggagcaaaagagtacaatctacactcttttataccacacatatttgttgtcctggtctttccgtgtaatcataatacaatcagaaatatgaaatacagaaaaacacactcatacaaatgcacatatacgtttgcgtatatatgatatatgacttacatatcctctcttcttcctaccaatgtgtcacactagttcacctttattcttcttacaccagtttcctaacctccttacacaccagtattttaccacttcctttaaatattctactcatgggtaagtattaatccccatataattctgctcttataagtctcattcaagtctatctatttttttttatcaaattctctctcttattcaaagtcctgaaatgacatgggcaaaagcaaaacataagcaagtacaactaataattctcttctaaattactatataaataaatatgtggataataattaacatttataccaataacagtattcataccaataacagtattcattttgaagctagagtcagagaatcattacagccacaccacttgtgaattagtgtatttgaaatgctctttggaatctagttatataaaatgatgcagggaattgaatgtctagaatatattgcttctgttgcaccctaatttttatgatgcttgagaaacatacagtggtcacattttatgtacaggattaatgaaaaccttgcctgattcaacgcacacaattcacaaattacaaaggataggagtgtgactctttatagctcaaatgtcacctctatttggaaataaggaaaatacagttgttttcaatacttggtctacttgacctaccagatttgaattgtggaatttttggcagaagtttttttgttgttgttattgttgttttaattcaagaggagcctttacttcaaattttgaacataaagtgagattttattgatatttttagcagatgttggttttccctgtaatgccaaaatgagcaactaggactcaaagctaaggcaaagggggtattcaatacctccacattttaaagtgactcactaaccactgggaacacacacaggctccttcaaggcttactgataggatcagctgaaagaaccctaccaagttagctcctgccatccaaccactgccagtcttcagatgcctgccatgctaggacactaaaatgaaagtcagaaagcagtgatgacttactgaaaaccagttaagggacacctgccctttcccctcatccttcccacaaggccagaggatctagacccagccaaaagaggaaaagaagacattcaagacacacggtatgagacaattctttccaacattctggagtgagaagaatgaaaaacagaccccaccctcatccttatttctggccaaccctgctctggaagaagggatggagatacaattcacatcagccaatgagttgaaaattttaactgaactaaactgaatttgcccagaaagttatgggatttgcctaggattgtctaaggactctgcaactcagatggaaagattcttaacagtatgcttgaaggaaggatttttaaatgttaataatacacttggttgaaattcctcaataaaccagatacactctttatagatcccaagcatgaatttacataaattggatttgtatcaaattactactatgtactttacttttgaaaaagctgatgctttggaactcaaagggtgagtgtggcagatgtcttgagaagggttgtttatgaatctatcccagatgggtacagaggaatctgtagccatgccaggtgataacctaggctcagcctatatccagcaaagtcgagctgctctggtctcagccaaataagtacaaattttcaaaatgtgattagctagtaaaatgaagggcttatttagtattcttgttctactgtgcttaccaatagtccaaaaactgataaaatctgcctttgctgcaaccaggaggcactgagccaaattttccttttgtaaattctaggctaggccaatgtcccattgataattcaaccatgcgttggttttaaaatgaacagagccacaaatgcaatcactgcctggcacaaacatgattactctggttgtgtaaacctacctacctagatttatatttaatttgctcagctttgaaaaggatgatatctaagtttaatgctgatcaaaacaaatattatatattgattgactttcttgtgcctgtgaatattaagaagcccatattttttgaaacaggaatcctttattttctctcatgttaatagcagccagttgtagcatgaacaaagcccatcaaagccttgcgttgccaggagccacattaaaacaatagtgggtcaagtagcaaatggtaccaaattacacaaagtgtttttgtccatggcttttttgtcttgagcagagaccagcaacacatgtgtagggtagtacaggttagaatatgcctacgtccaaagatgaaaactgatatttctgtctgtttaaggtattttcttttataattatattaattcataaaatcaaaatgtgaacatctgaatttatgtctataaatatttctttgtagttggtagtaaatttggtatactactgacaattgataaaaagcaaaaacacaaatataactcaatataacaaaaatataagctataaatcaatgacagttatattgtgctagaaacacatgctttatgaaatgactatgattgcttctctttttttctaactccattcaaataatttaagtttttcaataaatttataatttaggttaaaataagctactaacttatttggtttagacttcttttgtgttttttagaggaaatggaagtttgctataagcaatctaactgtgctttttcccaaaaaagagacaaaccatttttcacctacagaattccaaggagattctacttatagttaactcatcctatgtaactgctctcatcgactttgtagcagatgacaatgtgactgtctcaggattctaatgattcatgatgtgaaccaaatttagctacagttcagctttcactgtacggatgctttattttgaattcatcaaaaataaaagtaaaatctgttggcttgacctgagcagacgcaaataatttataatgtccaaaaatataattttggtatttgatatatattttatcttcatttaagttcaggttgtcctaaaaataaaatggaaaacaatctgcaaaaattcttccttatatctgttttgataaaggctggaaataacaaaactcatgagaaaattcaatcttgtaaggtttctagtttgatatttaaggaaaagtaagggctccacattctttattacttaactcaaaattcctttccacaattcaaaagcaaggaaaatagaaaaggagaaaaggaaagaaggaagggaggaaggaaggaaggaaaggaaggagggagggagggacagacggagagagggagggacagacggagagagggagagaggaaactgaaatcttatttacaaagcctagcacaaatgagtaagctatttagttagtggagtacttctgtgagtaaatagatgtcgtagaaaaagtggaaggggtattattcaaaattgaagtcattataaagaagtttactttctttgtcagcatgtatttataaagtgctctcactccaatgtaccagacactgttctacacgctggtgaaacagcaatgaaccacataaataaaatttctctcataacagagctacagcctcatgggagaggcaggtaattacctatataaactaatacatatttcaatggcaaataatagtaagagctaagaggaaaaattaagcaaggtgtgaggataaagagaggtgggtagggagactttggggaatagattggtcaggggagcattctctcaagaagcaagctgtttgcagagaactgagggataaggagagagccaggaaaggatctgagagaagatcacagcaggaaaaggaaaagagaaaaccatagtagagattttctaccaacactcacatcttctgatccttgtgccagccttttccagtcttactgatgcactaaatttttatcagcttttgatgctaacttcttactaaagaataactgtgttttcagtgcattgaaatgtatatcacataaatgtgcccactttttaataatatttatttaagagctggaaacaaagccgtgttttggagacaaagtagtccataccttcattttaaagaagtggaaactgagtaccagaaaggctacatgatctccctactgtcacgtaactaattaatataagtgtaaatcttagccttagtctggctgtcttgcttattgttatttgtatatttcctctacttgactctgagctccttaggagtacaaactacacatatatcccctatcagagtctggtagagtctaccaggatgacttacatatcactggtcgtcaataaatatttcataaatgagcaatcactcttctatgtcagtcgttttccaaaactgtccagatttcttcaaatcctatacaatctctttggtaaaattgctttgtgtctcctaatggaattcttcaataaattggcagagatgtacttcacttactattctataagtgccgataagattaagcatggttcttgccaaatggttcatgatccaaattagaaaggaagacagaatatataaacacagaggaattcaggaacatgttcatttcatgcctggattgtcctgctgaattattgtatacgtaatttcgatggaaagcatttaagaaagaaactttacgtttaccgtagagacctgcacacattgttggcatgaaataaataatcaacattgataacagccaaaattcaggcaatgtgttctcaataaaatacatttgtctcttgattcggcacatatgctattaataaatgttttcttacctacaatattaggcttagtttattgttacacttccaaaatacataaacccaaatcagggctacaaaggttattttcatttgttctatgtaacttgtcaataacaacaaggtacaaagttatacagcgtgggaatatataactagggtagttgacagtgcttaaagaaagtaaattcttcctaaatttgtccttcccttgcataaacagtattaaaaaaataaagtcttgcagaaagacagcaataaaaaaaatgacctggttttctatgcccaagttctcagtactttcagagcataagttaaatgtctcagcttttccaccgtgcaattcagagaatgtggtgggaacagaacatgaaggcaactcagctggaaaatatcttagatgaaatatttttgtcgagcacttttctcatgtgaatttgcctctgatttggtatataccagttgccagagcatggcattcattttacctcatgtcttgaggatttttttttttaatcaacaaactgttacataaaccaacaggacaaaaatgaaaacaaagcacccgggtttgtgtttaacaggagctctatgtcttatgcggtcaatagacaagagtcaagctttaatatcctcaaagttcctttcatgtgataaaatggcaataaggaaaactccttaaggctgtctgcctagtttgccttcttctcaaaatcagattcattattacccacaaggattcatctgtattttttaaagatacacatcaagtttgatctcttgttattcgaattgaataataacaacctaaatattaaaagcatgttttccccagatgtgctgatgtctcaataggttcttttttatgtcaagggaaacaaggtacgtacaaccgcttatcagatttacaacttataaaactgatgtcctggacaaaacaacagcttatccagtaggtgtcatctgataaaaaaatatttcacatacacacaagaaaggagaaccatatgaatatgtgatagctagaaaaacactctaaaaattaaccctttaaatgacgaaacaaactaaagacatcttgaccccattaagagttgacgttgcagtacactggttctcaagggatctcaaatttcactgttctggaatagggccaagcctcaagatttgttttttaagttccacaggtgattctcatgtgcagttaaaggtgggcaccaatgtgctatattaacaaggaaaactaaaatggtgaatgagataaaaccccaaacatataactcctagtattctgaaaatataattctcagaatacagtaattgatcaaaaggaaaaaaaagagggccttaaaaatgtaaccctggtcatccaaatggtcatttaactttatttaacattgatcaataaccgaccacgtttctgtggagatgaatcttccaaagtactgtcagtgccttcccacaccaccagctccaccataatctcataaaccccctcccacagagtactaaagtatgtttttctttcaggtattgctgttctagctggactgaatctggctccaaagttttcagaaatcacacaggacacaaatgatgtaatcataaaatgcgtatttattatggcaatgctgatgccgtcctagaatccattcctaggagattagcctacaaaaaaaagagagacaatctctgctgaaaatatattaattgaagtactagaaccctttgtttgctcaaggacccagaatttcacatttagtaacagtaaccaagactctagggtatgcagggaaagagtgagttcatcaagacgtagtcattaaagcctcacttctagtaccaatgaacctatagtttatgcagtcacaaaaagaagagaaaaaggaaaacagcccagatcagtattaaatcatttaaacctcacttttaagtttgtaagcaattctacttcaacttagtcagaaaacacaactgtccactgttacccttattccacaaagaaatatgaattctgtctctttgctatacctcctaaagaagaactggtgtcataatgtaccttccaataaagacaactaaaattaaatacaaaggatatggtggggggtcattaattttcagtacttgcccatttttgtggtgtaaatattcccaatcatggcagagttcaagctaccaaagtgatgtgagccaggtagcaaaagtcccgaaaatgtaacgatgtactctgatgagctaataaaggggacatcagcataccactgtccattagcattcagtttatcttacctagtcactattgtatatatgctagaagcatgatcttatagaagaaatcattatctactcaaaaatgcttaaatgtattgagcttacagttcatagggagatattctttgaagaagaaactccccaaccaagacttacgcctttatttcatgctgcctgctctatttctagaccctcataggaatcaacaaggattgacaatctcactccctcattcttaagaaaaattttaactcagtagttttgatttgggcatggttttgcggtattatacaatgccaaatgctgtcagcatcctagctcttcaggtccaggaattttgcagccctagaggaacaatcacaatgtcgaagtactcattacagaccactgttaatgaaccagacactctccatcaagcaggagccaggctactccgatggtggaaagtactagaatgacattccagaatttctcattagtaattatacaaagcagaaggatattctgtaacataaattgcaatttagatcaattgcatggctttatgaaattagtgttaaatcaataaccaaatgtttatttacataagttttatgtgttttatgtaataaaagaaatcatatttttaacaaattcttttttgaagttagggggaaacttccattctcttggatcttatataatgtcagcccattatcagtgggtaatagaaaaatgataaaaaaggggatgggcgaagaatatttaacatttagtagtttgtgtggtttagttgtaattagtctattcagttattttcccacaagtctttctgggtctccttaggagagggatgagaactaagaggcaaagagagatggaggttttcaccaggtttttagataaattcttggttatttgtcccttaccaatacctctagtcatagatagttggaagtcatcactcacctaacaaaagactaaagaggtattgagggaagaaaccaccatttaactatatctgaaacagatgaatttagtgcaggttcacatagtgcaaaatgcactctctcaaacaaagcaaaggtccaatctcgtattgggttcaaggaatgcataaagttcagggattggctgatttttggaaataggagtgtattggtattggctttcattgtggagtttggcgactggttaactttcagaagcatgagttccagagcaacactgctgctggttgtctggaaagggttaataacccattttttggttacttgtctacaacttgagactaagaccaaagaatagtcgttctttacttcctttcattaacttggaaaataggaacatttcagtctcagaaaaaaatcaggaacagtgattgttacagttaagtatagaatttcttatagatcatacaatcctattacatttattggaaaatatgtgtagtcttaaaaaattaagattttttactttattaataaacaatgttgtttactaatatgttaataatatattatgtttttataattaatcatcaaatcactaataactccattataagtgattagatttaggctttcaaaaataaattgtatggtatatatttgagattgatgaggaagtatgcctaatgtgaacaaccaaagttaaaatattaaaatatgggctactgcatgaaatcatttcaggggtttttaatcccacttttatctatttctacaaatggaaatttaggattcagctagacctgtccaaaatccaactctattattcactagatatgtgctatattttcttcattaataaaaacaaaaataatttttaaggtttgagaagcaacatatagaataaatttctgccttcatatgtaacacattgctaaaattataaacagaaatgaaatgtaagaatattaaattattctatgtcaagactgttgttaaataataatgatgatgttgactatgaagatttaaaaatttttaaaactctggttatgacttgcaatatatttctattatttttatataaggtttttattttcttcacaattgacatcacaggctgagacagaagttttactactttcagctaaggctggcagcaaacgaactacctgccttcaggaatgaaacctgatctatttcttctctttcttcctctcactttacttttctttttcccttactttaactgctcatttcttagacttccaggaccaaacatgtggcaagataaagaagagataaaagaaatgggaaagttatttcttgtatgaactgtcccatcatctttaggcccagcagaaaattaaagaggcttgttttctcataggtgcttttgtaggttcggtggagattttcatgctgtacacctccaactgcaattcccttgaccaaggcagtgcgtaccttggctggccctaatgcttatgtgctcctgacctctgtgttataccccttagccacttacgctggggttcttagataagacagaactgcttcttctgcaggacctcatgtttaaatgactccaggctaacattcccactgaatttttcccatggcttcaattcatgcatcttcggccccataaaagaagcacatagagaaactttccaaatgcagtacttttcactaaaaggctgctttaacttacttagatgtgactcagatacaagtccactctgttctccgattataagaaatgtacatcaagctctgtgagcttctgaatctctgaatccctatcacaaaacttgaggtgaagacacctttccaacaacacccatatttcccacaggggtgggtatccacagcattcagcattctctccaacatttctcctcaaaaaggctggctctctccccactttcttggtcctcaacatgggtttgagagtcatctctttggttctcagatgagagattagtctcacaattcattcttgagtgtagccctgaatgtcttcaaatctccgcaaaaactgagagaagagtcctgtttaacttcctgttatacatattaaagcacaatgaccccagacagaatatcatctctgttgtgggctgtacattgtattgatcacaaagtggtaccttctccaaaatatccatttcctacatatcagctcattctgcatcttttcagttcctagttattttttttcagtgacatactttctttacttttttcatcactataatcttattaaaaatcttccaaatacttatattttgctttaattttcagctcaaaaaaactttcagatagctgaacaaaaggcagcagaaacttctgcagacttaaacatccctgtctgacagctttgaagagagtagtggttctcctagcacagagtttgagatctgagaatggacagactgcttcctcaagtgggtctctgacccccgagtagcctaactgggagacatctcccagtaggggccgactgacacctcatacaactggatgcccctcatacagctgggagacaaagcttccagaggaaggatcaggcagcaacatttgctgttctgcaatatttgctgttctgcagcctccactagtgatacccagggaaacagggtctggagtggacctccagcaaactccaacagacctgcagctgagggtcctgactgttagaaggaaaactaaccaacagaaaggacctccacaacaaaaccccatctgtatgtcaccatcaccaaagaccaaaggtagataaaaccacaaagatggggagaaaccagaacagaaaagctgagaactctaaaaatcagagctcctcttctcctccaaaggaacgcagctcctcgccagcaatggaacacagctggatggacaatgactttgacaagttgacagaagaacgatcggtaataacaaacttctccgagctaaaggaggatgttctaacccatcacaaagaagctaaaaaccttaaaaaaagattagacgaatggctaaccagaataaacagcatagagaagaccttaaatggcctgactgagctgaaatccatggcacgagaactacgtgatgcatgcacaaacttcagtagctggttcgatcaatcagtgattgaagatcaaatgaatgaaatgaagccagaagagaagtttagagaaaaaagagtaaaagaaacgagcaaagcctccaagaaatatgggactatatgaaaagaccaaatctacgtctcattggtatacctgaaagtgatggggagaatgcaaccaacttggaaaacactcttcaggatattatccaggagaacttccccaacctagcaaatcaggccaacattcaaatgtaggaaatacagagaatgccacaaagatactccttgagaagagcaactccaagacacataactgtcagattcaccaaagttaaaatgaaggaaaaaatgttaagggcagccagagagaaaggtcatgttacctacaaagggaagcccatcagactaacagcagatctcttggcagaaactctacaagccagaagagagtgggggccaacattcaacattcttgaagaaaagaattttcaacccagaatttcatatccagccaaattaagcttcataagtgaatgagaagaaaatattttacagacaagcaaatgctgagattttgtcaccaccaggcctgccttacaatagctcctgaaggaagcactaaacatggaaaggaacaactggtaccagccactgcaaaaacatgccaaatggtaaagaccatcgatgctaggaataaactgcatcaactaacgagcaaaataaccagctagcatcataatgacgggatcaaattcacacataacaatactaaccttaaatgtaaatgggctaaatgctccaattaaaagacacagactggcaaattggataaagagtcaagacccatcaatgtgctgtattcaggagacccatctcaggtgcagagacacacataggctcaaaataaagggatggaggaagatctaccaagcaaatggaaaacaaaaaaaggcaggggttgcaatcctagtctctgataaacagactttaaaccaacaaagatcaaaagagacaaagaatgccattacacaatggtaaagggatcaattcaacaagaaaagctaactatcctaaatatatatgcacccaatacaggagcacccagattcataaagcaagtccttagagacctacaaagagacttagactcccacacaataataatgggagactttaacaccccactgtcaacattagacagatgaacgagacacaaagttaacagggatatccaggaattgaactcagctctgcaccaagtggacctaatagacatctacagaactctgcaccccaaatcaacagaatatacattcttctcagcaccacatcgcactattccaaattgaccacatagttggaagtaaagcactcctcagcaaatgtaaaagaccagaaattataacaaactgtctctccgaccacagtgcaatcaaactagcactcaggattaggaaactcactcaaaactgctcaactacatggaaactgaacaacctgctcctgaatgactactgggtgcataatgaaatgaaggcagaaataaagatgttctttgaaaccaatgagaacaaagacacaacataccagaatctctgggacacatttaaagcagtgtgtagagggaaatttatagcactaaatgcccacaagagaaagcaggaaatatctaaaattgacaccctaacatcacaattaaaagaactagagaaggaagagcaaacacattcaaaagctagcagaaggcaagaaataactaagatcagagcagaactgaaggagacagagacacaaaaaatcaatgaatccaggagctggttttttgaaaagatcaacaaaattgatagactgctagcaagactaataaagaagaaaagagagaagaatcaaatagatgcaataaaaaatgataaaggggatatcaccactgatcccacagaaatataaactgccatcagaatatattataaacaactctacgcaaataatctagaaaatctagaagaaatgggtaaattcctggacacagacaccctcccaagactaaaccaggaagaagttgaatccctgaatagaccaataacaggctctgaaattgaggcaataattaatagcctaccaaccaaaaaaagtccaggaccagacggattcacagccaaattctaccagaggtacaaagaggagttggtacgattccttctgagactattccaatcagtagaaaaagagagaatactccctaactcattttatgaggccagcaccatcatgattcctggcagacacacaacaaaaaaagagaattttagaccaatatccctgatgaacgtcgatgcaaaaatcctcaataaaatactggcaaactgaatccagcagcgcaccaaaaagcttatccaccatgaacaagttggcttcatccctaggatgcaaggctggttcaacatatgcaaatcaataaacgtaatccagcatataaacagaactaaagacaaaaaccacatgattatctcaatacatgcagaaaaggcctttgacaaaattcaacagcccttcatgctaaaaactctccataaactaggtattgatggaacatatcgcaaaataataagagctatttatgacaaacccacagtcaatatcatactgaacgggcaaaagctggaagcattccctttgaaaactggcataagacagggatgccctctctcaccactcctattcaacatagtgttggaagttctggtcagggcaatcaggcaggagaaagaaataaagggtattcaattagcaaaagaggaagtcaaattgtccctgtttgcagatgacatgattgtatatttagaaaaccccatcgtcccagcccaaaatctccttaagctgataagcaacttcagcaaagtctcaagatacaaaatcaatgttcaaaaatcacaagcattcttatacaccaataacagacaaacagagagccaaatcatgagtgaactcccattcacaaatgcttcaaagagaataaaatacctaggaatacaacttacaaggaatgtgaaggacctcttcaaggagaactacaaaccactgctcaatgaaataaaagagcacacaaacaaatggaagaacattccatgctcctggataggaagaatcaatatcatgaaaatggccataccgcccaaggtaatttataaagtcaatgccatccccatcaagctaccaatgactttcttcacagaattggaaaaaactactttaaagttcacatggaaccaaaaaagagcccacattgccaaggcaatcctaaacagaaagaacaaagctggaggcatcacactacctgacttcaaactatactacaaggctacagtaaccaaagcatcatggtactggtaccaaaacagagatatagaccaatggaacagaacagagccctcagaaatactaccacacatctacaaccatctgatctttgacaaacctggcaaaaacaagaaatgggggaaggattccctatttaataaatggtgctgggaaaactggctagccttatgtagaaagctgaaactggatcccttccttacaccttatacaaaaagtaattcaagatggattaaagagttaaatgttagatctaaaaccataaaatccctagaagaaaccctaggcaataccattgaggacataggcatgggcaagtacttcatgactaaaacaccaaaagcaatggcaacaaaagccaaaattgacaaaggggatctaattaaactaaagagcttctgcacagcaaaagaaactaccatcagaatgaacaggcaacttacagaatgggagaaaatttttacaatctacccatctgacaaagggctaatatccagaatctacaaataacttaaacaaatttacaagaaaaaaacaaccccatcaaaaagtgggcgaaggatatgaacagacacttctcaaaagaagacatttatacagccaacagacacatgaaaaaaatgctcatcatcactggccatcagagaaatgcaaatcaaaaccacaatgagataccatctcacaccagttagaatggcgatcattaaaaagtcaggaaacaatgggtgctggtgaggatgtggagaaataggaacacttttacactgttggtgggactgtaaactagttcaaccattgtggaagacagtgtggtgactcctcaaggatctagaactagaaataccatttgatccagccatctgattactgggtatatacctaaaggattataaatcatgctgctataaagacacgtgtgcacgtatgtttattgcagcactattcacaatagcaaacacctggaaccaacccaaatgtccatcaatgatagactggattaagaaaatgtggcacatatacaccatggaatactatgcagccataaaaaaggatgagttcatatcctttgtagggacatggatatgtccctacattctgaggaaactatcccaaggacagaaaaacaaacaccgcatgttctcactcataggtgggaactgaacaatgggaacacttggacacaggatagggaacatcatacactggggactgtcttggggtgggaggagggaggagggatagcattaggagatatacctaatgtaaatgacgagttaataggggcagcacaccatcatggcacatgtatacatatgtaacaaacctgcacgttgtgcacatgtaccctagaacttaaagtataataaaaaaattaataaaaaattaaaagttcagtgtcaggccaagtgcagtggctcacgcctgtaatcccctgcacttttggaaggcgaggcatgtggatcacttgaggtagggagttcaagaccagcctggccaacataatgaaaccccatctaaaaaaaaaaaaaaattcagctcaagaatcactcttggctttctcactcttttcatctgtctctttttacctaggtaattttgttcagtaatatttctcacctacacccattttgagtcagaatgagtgaaaagaagatgccgttttctctgtttccaattttggataaattgctagtctccttgcaagtagtaatctttactcatccagttgtctttcacaaatagagcaaagcagaatctgcttctaagttaaacaaaaagcagaaatcataatgtcaaattataattggcatatcccagacataatcaatattgccttttgcaagttcctcccacagctaaagcaaaccctggttagtgctggccaaatcttgactaatttggcttcaagttattaccatacttaatatctctgaatcaacactgatgactaagataaagtgaactacaagaaatgatcagtcttcaatgtgaaaactttttcactttgtgccaactattactggtgcacctgttttatgttcagagtgggaagagaatcaaaaaagacgtggccaattttgaaaaagatgcaatgttttcaatgtctcaaaatagctcacatacatagcattgcttccactgcttattcaaactgtgaggctgattgagcatatgtataatgcaggcatgcaaatcaaaaaattacctacattgctcccaccttactctctcaggttccagtttcctgtataagaattggtactgcatcaagtagaggcagaaagacatcagcagttcagggaatttttatgagaggtacaaaaagaagtaatgtgagagggctttaagaatttctgatactgcatttgcaaggggctctagaaataatctagtccggcccctgtttttcagatggagacctccactattaattcaagtagattgcactggataagccaacatcatagtacaataaagcctctgtcaactgaattacaggaaattaagaagaaataaactttatattaactagagtcagatggatccaaaattgtggtcctagagccataacagggctcggaaatttgtgataagaaggcattttaaaggattatcgatgttaataaaccaatatcacttgcctgaggagcccacactgggaaagtggaaatacggaaaggcatgttctagattcattctttctaccaattttgtgaaagccactgactctcctagggctcaggacaaaacataggcttaggtacgtgggtgaaaacagagactctcatctgggaagatcacgaatagactatgagtgactatgagttatgagagtctggccaaggatcaaccattaagggatgggcacgctgcaatgagaccaaggatgattcaaaactgaggagaaatcctccaggggaaaaatattcagggttttaatatatccaagaaatataagatggaaagtgactagaaatccagaaggtaaggatgcatatccaaagaatattctaaatattatctagcagaatagtggagaatttaatgatgtgacaattctttgaagggtgaatgtactttacattatacgggtattattctgttgactgaaatagtcatttcacttaatcttccaagggtaactttttaaaattgatacaataccattttaaataatataccaacattttctaaaacgattaggtcactgtttttggcaattgattaataagctcaatttcaaatcaactcattgcagtttaacgcaaaaacaatttttaactatttggtacagggcaatcagaatacaatggtgaacagaacacaggacctgttctcatagaatttatagtatgacagtgaaaacatctactgagcatctaaaaacatggtgaacactaggaaatgaatgctatgaaaatctcctacaagggaaattcaatctagtctatgaaatcaggaaatgtttccttggtaaattatatatcaactatgatttgaagaattagtataagttagccaggtggaaatttgaaaatgtgggtagtatttttggctatcaccctgccttctggtcaactggcaatcacaggaatgaattcaccaactaactcactggattgtggaaaataacatatcatttttgtttgagccattctgttttgggatatttcattatatagctttctcatggcctaggcaaagtactgataagctgaaaatgctactccgatcaacctgagacactactggtattaaagcctgattttttaatgctttcatagactaaaaactatgagtacccaatactgaatcaggcacttaattattttgttgacacaatgatgaagggtatttattatgagcatttagtggatgggacccagaaatgctagacaccttgcaccaccacaaattattcagtattcctcttgacttgagaatatcatgctagacgttcattagataatgaactagagactacaatttaagtcttttttacatataaacacaaagtatgctttatgcagttttgatatccataatattccaggaatgcaattactgtggaaaaggacagaaaattgtattctattttgtttggaagtttacccaaagttgttcattattctggaaaaccacatccctgacagcaacaccaggtatggtacttgagctctagcataaaacacctgtatcagtttgcagttgtgccatcaaatccataggaattcttcaaatagggacatgcatctgactgtctcactatgtgtgaaacaatgtttgccagaacattcacatatggaaatacatatcattttaatattaatcttttcatttagttttcctttatataacagtggtagcattattgattttatgttgtctgtggagtttatttcaggaaagtggaggtaatgttagcaaatatatattggaaaaagaaaattttggccgggcacggtggctcacacctgtaatcccagcactttgggaggccaaggcgggtggatcacgaggtcaggagatcaagaccatccttactaacatggtgaaaccccgtctctactaaaaatacaaaaaattagccaggcattgtggtgggcgccttcagtcccagctactagggaggctgaggcaggaaaatggcttgaacctgggaggcagagcttgcagtgagctgagatcgggccactgcactccagcctgggcgacagtgcgagactctgtctcaaaaaaaaaagaaaaaagaaaaaaaaaaaagaaaattttggctctgagaagattgagccatagctctgaaggaaaaaatatatacacattataggccatcaaattcttatgagcattttaaagtgttggcattttttaaaaaaggtattatttttgcatccaattgattgcttacccattcttagacaattccatttggtttgagatatgggttaaaatgtgtgatgtttatggccaatataaatgcatgtgcatgtcttataggttgggtaagttcctcaatagttcatcccttttctcccccctccccaaggcaagaatcatttgtactagtgctctttgggcaccagcaaagtccagtctttttcaaccaattgttctatagaacatcaaaattgtcttttttgaaaaactcaagtatgaatcagtagcagaactctcctctgcccacacagttctctgaattaacttttcttgtttttcctcatgttttccgtctttactcactgttttagctgctgattatccctctaaaattccaagtgatatatttcttctgtcttgaattttccacttttatatttctattctgccttctacactgccacctgagtcttccaaccttctttcttggtcactaaatctcaactcaaggagcctctaaatcattcacctatttcctgattttttgcctcttcctacaaaaacacctgtaaatatcagcccacataaatttctgttgaattttattgtgtcagatgcttccaggaaaaaaaatatgcttttgcataatcttgaatttttgtgtgatttggcaaagtttttaccttctttttggcttattatactaatatgtatattgaggttaattaaaaaattaacttcacagagttgtgagcatgaaatgaactaacataggttaagcacttaaaagagtgttcatacacagtaagcactatgtattattaccattacacacaattttagaagttatattttactatattttagttcaatgtttaagtgcaataattttaactatacttagcaaaacacactaattcccacttaattagaaaatgtgctgattatacaaatataaatatacactataaaattctagagagccccaggagacacaaagaatctggcctatttccaaatggaatctgcttcaacacagcagccttgctgaggcagtcaaacgcagtcactaagtattagactaggtagactctgtgctggctccattgacattcactggagttttggcccaactaaggtagcatgaaccctccaatttggtggcatcatctgaagttcactccagactacaggatgtgaaaagccatttactgtgctttctggaaatttcaatctcatgggaaaatgatttattatctagggagttattctgtgcatgccatattattgtcgactttaaagtccacagaaggtaagaaatcactttaaggtcttacctgcattaaaattaaccagggtgcttcacttttttctctatctctcaaagctgtgttttaaatagacaagggggtggtaaggatacagaaaataaactgaatttatttactgttcacaataaactgaacagtcatgaacctcattttactaaagccactggcaaacttccttagtaattgcccacccaacatctctttcttgactgataagcttatccacttttgcaaatgtcctaaatagaattctcactgtatggctgaggtccctacatcatgtacaacacttcattctgagattctcagaaaaggagcaggtatgtcccaagcccagctaagactggctgtgaacgtggacacagagtgtggaatgaaaaatactggagactcagaggggtgaggggggaaggagaatgtggtgatgagaaattacttaatgtgtacaatgtacattatttgggtgatggatacacaaaaagctcaaacttcaccactacacaatatattcatggagcaaatttgcatttataccccttacatttatataaattcatatttccttcttataccttatatacatataaatacatattatatataatatatgtattatataaatatatatattatatatatatatatggtataagaaggaaatatgaactctgcaaaagcaacaagacatacatccccagaagagagatggtttaaggaggtgctgtatctcatgttcccagtatgggcactgggagaagcttggccttcagccggggcagaggatgagaggaagaggtatggattattaacaacagtagagtgactaagaaagaggtattgggagccacacaacagtcatggctttggatagctgtcagataggagaaagatggtttcttgagcttttggaaaggaaagttaggcttaagcagtagaacaaaaaagcataaggatttaaaacacaatgaagaaaaaatctgttcttacatccacccttcctttttctgtcgtctcttccctctcaaggcctattcttaccccttactccaataagtcttctctctttcttactatatctcttttccctcaatgtctcaatgtttcttatttcttcactggacatgatatacaattgtatttttgtatgatttatgacatttatatgtatgtttctcagaaaatatattaagctgcttgaggggttttttttggggggggggttaagtcttttctttctctctttttttttcttggctgatgattattggttccccatagaaaaaaaaagttacccaccactctgagtagttcctttgctaaagcagtaaattgtatgacataatcaccaatgttttaaaaggacatgcaatttatccgaagaagttagttgattgaagatgtgaattaatgtacagaaaattagtcttttggatggttcactcaatcagagagagttacaaagttgtagaggcaaaatgatttcattgacaagtcaaagatattatctccatttcttctaactggttattttttaagagaaaaaaaactgattttgatcacacacgtacgtatgggagttcacaaaaaaatgtaactcaaaggagcagttagaattggaacttaaatactatcttattagatgaagaaggagagggataagggaattatgggaaaacaaatgactcttatgaaatcgaaatagagactagattggaagatatgatagtttttgtgattgtgtctccttgggtgtagtttggagacattgtctttggtaatcagagtcaatcttcctcagttgttccaggggtgaggatttatgacaattgaggtattttgggaagctctacttttaggcagataaagagatttcaagaactcaaatgccttcaactcaaaataatttttatgccttattgttgtagtctggaccccttctctagggtattcatagtacttgcacttcctccttcccaggtgtaaggaacatgatattaccaatatagtgggccaacatcatactctgctcaataataggatgatcaaggactcttcagaccatgacacaaagcagaaaaggtaacttagtccttgagtaagaccttgaatgtgaaccgctgcctgcgccaagggaatactctgctccttcttccggatgaaaagaatgcatttgccaaataatagctacataaaactgccaaagactaagttgatctcttctagtaaagattccatatcacccacagcagttgagatcagcattacctcatgcttaagtgatgttagaccactaacatttgacacaatccatctgatttttgcaaagacctaactggtaaattaaatgaaactgtgatagagaccatcacctttaagtctctgagagtgacacactcttcaccattctgcctaggatgtggtactacttcctatttaccatcttggttgggcttgaggcagttttaaggactttcagttgtcctctcttaccataatggctctttgttcatcgtctagagcctaatgtgggtttctgtcagttaccaagaatattcatcttgactgtaggtcagaaaaatgaccacagactgggtttgtggacccactgcaaccagtgtgaaacaatttgggccaggacttcatttatcacccagcatttgtatacctccactctatcaggagagccataaccgtgtctgagctgccctggtgtcagcgttggctcagatcttgtatttaacagcactcaaaagctctggcaggtcacccttttctcagggtacagttgctctcacaaattttaggattggattggaggaaattacactgaatataccaaaggaagaaatatacttttctcaggacccaggatccccttcagttgatgggcttcagtatgagacatggctccgttctagaaactgggtgaagggttattattttccattgatattagctctgttcacccaagcttaatttaattttgtgtgtaagtgaagctatactattattgcctgcctatctacctcactcccaagaacaacatggtctattagccatacccatagaccccatagacttgaacatgtcataagataatattgcaacaaattcagttcaaaggtctcaattcgcttttatttgtgattctagaattctattttatagaatgaggtgttctcatgagctgaagagaggaaagcttgactttataggcagaaaggggctgagaaaagcagaaatagagaataaaaagcaaattggtcaatatgaagtggctttccttctaaaaattaaagcaaagagggcttccttatcatgcctgctaaaactggcttgttacagggatttggctattgtttctcctgatttcttggaaggccagatagatgacttaattttgacttgataacatagagtctcagcattggaaactctatgttggtttgttctgttgggcctaatgcaggagctcagttcagactcatgacctctcataaattttatttaacaaacctgagctaaaaccataaaacccctacatgaaaacatgtaaataaatctttgtaaccttgtgttaggcaatggctcattaaaatgaaaaaactttggataaattaaatttaatggagtttaattgagcaaagaacaattctcaaatagagcagccaccagatttggaataggttcacagtgacaccagggctgccacatggtcagataatatttatagacagaaatgggaaagtgatatacagaaaacagaagtgaagtacagaaacaactggattggttacaactcagcattttctttatttgaccttgctttgaacagttggctgcctgtgattggctgagactatgtgattgtacaacagtaagtaagttacagtcatttacacatccagttagattacagtttactatgtatgcagaaacctttaggctgaacttaaaataggtacagagatagttttatgttaaacttaatttgacaattatcctgttttggtcaacatctcaattttgcaggattgactaaaacgttaggcattgacatcactttgtcacctttgtaaattgacttatttggtctcaaatcccactgggaaatagacagaattgtcagttttgcaaggtgggaacaaggaaacagaacaatagaaaaaaactgattggtaacttcaggttactttcttgtaagtgttagaacggaggagactttcatattattatggagtctcctgcttttaggaagacctacatggtattttgagatctatatgcttccttaaagtttcagtttgtttacactgcatttagcatgagagactccatttttgtttggtctggtctattggggcctagtgcaggagctcaatccagaaaaatggcctcccataattttgtttaacaattcctctcttttggtcacattctcacctgagaacgtgaccaaaacttaaggctttagtgctactctcagttaccattttggggagctgccagtctcaataaatcattcacaggccacagtgtcctcatggtcatgcatttctttgagtttttgttattctggtcaaagagagaccatttgacactctacggatggctgcatgcaaacatttaaaacatttgagagaatacggcacaccagggagactactgttatgaccaccaggaggataataccaagaccagctggttatattttaaataaatgttttcaaaaacatctctaatgtgcttttgttatcccctatgcctcacaccacttctttaaagatattcattaaataattagaatggtattatttcatgtttgtatggagtattacagtttacaagatattttcatattataacatcttacaatcaccacaagtccacaaggcatgtaggggaattattttttatatgaatattatagattaggaaattcagactcagaatatatgacatcccaatcatttatatagttatgactggcagagctaatattcaaggcaggatctcccaactccaagtttaatgtgttcctcctacaccacaggacttctttagttagaacaacccaacaaggggattacaatttgaacaaatgatttacacctatgcaagagatgaggccatgagctgagaaaaaatgcaatatttaggttgtattctttgttatttaaagtataggggtcaaaaataagcaagacaattgcccactctgcattgttttgttaaaaagaaaaatctagagtgttacgttcaggtcggttctcaataccaatattcaagagttatgtcaacagaataaaagcagtgcttctaccagaagagtagagaaaatattaacggtaaagagaagtcaggtagataaaccctccacttcacaccacagcataaccagatatattaagggtagctggctgcaaccatacgatttcagttttttaaagcatgaccctgtgttaatagcctaagtatcctcaactcttccaccctttttgggcttccctcccctacatttaatgatttaaatttttaaaaatgatctcatctcacaaaatagtgaatagaaaatccaatgtcaaccccaaccccaaacatcttcaaggatctctgtagtattattgctctcttgctcactctcttgacccagttgtaaaatgtggccctctttttcatcatttctctccaaaatattgatcataaaaagcactactagataaaacgcagtgtgtggaatagattttaactgcaggttaagtggaatgtgtatgaaggtagacgggaatacacggaagcatcatgaaaaacaaaaaactaaaaatgtagtcccaatatccctactccttaaccgcttttgccattaccttcacagagatttcttttccatagtacatactctcttttcaggctctggcctctggccatctcacttcacctcttgccttctgctttctttcttccctatcacttctcctttactctctccctcttagaaagctattgagaaaaaacacctcacgcagaggactcaccttccagaccacatcctggggcctatcttttcacactcaaattgaacaattgtttgcttccctaagaaaataaaattatctcccaaagaagtgggatgaaaacttttagaattacctaattttctcccatcaaagaaatcctaatttttatcttagaaattccagaatttctagtagaaatgttatattctactctacaaaatacccatctttgatgtaaagtatttttttaagcaatgtataatcaagtaaaattaatactttgaatacattcacagagaagaactgagacaaataaatggaagttatgggatagtagtgatttgctcaaaagaagttaaactgctcactggagctatctgaggtctcatgagctagaggtatccaaaactggaaatagtcaaaaagatatagacaatgacccatgggacagagtcccatgattctcagagacaatcacccattctgtaaagagctggactcaacaatgtctaaggtcccttccaaccctcagaatctgttttccaagtctcaatcactcaaggcatgggtctttgcacacttgcagtccgtcctgtggtttacaggataacttcattgtttggctcaaagtcttttctacatccaaatatttatacttaatattcaaagaataacatcaaagcacattaaaaattccaatatagaaacatttaaggagctgttcacacctctaacctgctttattgatttgtattgctgtgcataaacaagatacagttacattaattattgatatacggactattgataagaaaacactttcttctaaatataatcttttctaattaggtatgagttaagaagagttaaggagaaaagaaagacaaccttcaaatatcagctgattcacacacaaaaataaataataagctctgtgtagaaattgtatatttgagaattcatgttatagaaccttcagtctagaggaaaaatcatacaccttaaaaaatgtttttcaaaagtcttcatgttattcaaaattatatggtgattagagtattgtcaggtgagaccaacaatttaaatgaaataaacacagtttttgtttcctgaccctgaaaatcaagtggaagttatgaaatccagaatatttcatatgcatgtccttggcaatacaatgtgaaaatggttgggtatccaaactgctttgaatttcagatagttttcttataacaaattcaagttatcttcaagattttacaagccaacttttctagatatagatttatttattcaaccagccaacatttactaagtatcttctaaggacacagaaagctatttctactaataccatgaaaagcagcaaacaacatttattacacacttactatgcaccaggcacagttatccattttacttgcattatatttttgtaatcaataatctatcataatagacacagaaaccaaagctggccttgatcacctatttgattaatagatctgcacaactccaatgctccattcttaaccattattctatatccccgacctacacaaaaagatgatccaatagagacaacacagtaaaattctttggtagaggcaaacatagaatgcaagaaaaagcccctaactctacctaggaaggtggtaactgagtcaaagacagaggttatttgaagactcatcaggaaaggtaatgtttgatctgaatcacaaggaaagacttggagttatccagaagattgaagataatgtgaaaagtccagagtcatgcaagagaagaatatatatgagaatctgcatttcagggtagctgaaatgggaatcatgggagattaaaataaacaggtaggtgggaggcatcagtcattattacaaactttgacttgccaataaatttgatttatttaaagataataaaaatcactgaagaatcttaagcaggggaattaagtgatcaaatatatatatttaagaaagatcattttacttgtcttcattgggcaatagatatggaggaaagaagatggactcaagacataggtgtaagggatcagtcagatgaggagagggaaacagacagagggactgtaagaatgtccaggtttctggcctagacaactgggttgatggtagtgcatttactgcagtaatgaagacagtcgatggagcaactacatggtaaaatacatgttctgttctactttggattgtcgggacctaaattggagatttgaatcactgtgaatttcaaagatctaatcaagattccttagctttttactcagaggccaaactcagaaatcaaaagagtagaagagtagaaacaacagcattttgtgtctaaactttcatcccttttaaacttggagaacaaagggaaaggggaggcagagagacaaatactctgagtttgctctttcctctctctctctctctctctctctctctctttatttatctctctgggtttatttgctgctagcagaggaagaggtatcttacaggtggtaaaaatgatcagcgcttgtgaagacttgagtggatactagggacatgtgatccagaattcctaggtgaaagcagtctgtaataatgttgggggcttgtttaaagagtctacttactcaagtgagtataactgccatattcaaagatagccagagctttggactctgaatctactaccttgacaattggatccttctttgtactacagataattttcctgtgatttctgtcatccccaacttacaaacatttttgctaatgccttgtctgtcatcatcttgtagtttgatgaggtgtttttggcccatgtaaaatatctgactaatggaaacagagctactgctagcacatacatagaagataatctctccttcaggcatgcctattacacaacagcaactctttggagagtgagttattaaatgtcctgcttggggtagacaaactagcaaaaggtgcctccttcctagggactgatataattgtatgccagtgtatatgttccagtctccagccagccagtcaagccagcataagcatgcatgggggtcttccatacaacaccctactttataatctttataaacaaaggaaattcaatattccacatccccaatgccattgcattgcatgactccaggagacaccaagtgcgtggaaaggttgtgatggtccccctggagttgcgctacgtggaagccctccagatattctatcccatccaattattatgtaattttgtgggtagttactggggtgggaattctctgacaaatgagattttttcccaaccctttcctactacacattgttcaacaggcctctgatctagtaattttaattctacctccaaattctatcttgaatctatgtcattctctccatctccatcttctattctgaggctctatcctctctcacctagaccagggttctcatgtgtccattatgctctcatctccagtacatttctcacagtgagctagaatgatattatttaaacagacctctggttatttcaccccttcttaaaaaccatcgatggatatgcatttctcttaaagtaaaatcctcaatcctatggccagcaaagtctctgcatagtcttcttctgtgttcctctccagcctcatctcctatcacccactgtctcacactatcctgcaggcacatgtgccttctttcagttatttaggctgccagactctttcctgtctcagaatatttgcatgtgctattgtctttgtctgaaattctcttcctcccaacgtttcatcaggttacccctgctcattctttgggttctaacattattgctacttccccagaggagtttcttgatctaaatcaagtcccataatgagaagtggtaatctctcaccgtctcctgtgctatgctgaatactaatcacaatgcattatttctgttatttattaactgcctctccccaggttgtaagcgccaccaagatgggggctacgcctgttctgttgaccactggatcctctgtatctagcatggtgcctgctatatttgatggataacagcgtaggtaacaggttgagagagctgggctgaagacatatttttagttcttagcaagtaacagacagataaaattgctggaaaacattaatagtaaaaagaaaagatggccaaagacagaattctagagaactccctctgggtagacagcctatgccaaagcaagtcaattcccagctacccagatgaaaaataaaaatctacgtgaagataatagtagtatggatggcagtggcattgaaggtagcagggatgttggcaacagcaataaagaggaatttttattttctacttaccatttgctgcacaatttcactaacttattttgatgtcaaactttatcacagctgagttctgccttctaagcatataaactatagaatataaaatttgcctctttgaaaaccataggcagtttgacaatatatttgaattaattaacctcttaactctggtacaagtccatattcacaagtatgacaatgattaagttaatgagttaatcattcccttctagttacagtctttcttaattagttgatttaaattggggagtgggaggaggaaggagaagaatcttctgtggagtctattttcatagtgccagataagatttctaaaggctttttttttgaaagatgcagaaatgtagacatcttttcaatactgtttataattttttaagctaccaagtcctactaagccgattatcatattttagcaaaagaaattgcttggcaagtacttcctaagtgcctgccctgctgtgaccatacccttaatttgggccctacagggaacatggggaggggagagatgtggcatgggctttccaggattgtgaatttgaagtttgctagtcatctaaccaaaaattaagggtgatggaccatatctccaagatcagttgcattctcttacagggttttagttcatatgcaacacttctaggtttaaaaaaaaaaagtgtcaaaatttactcgaatgtcaccatatgaattagaccaggccctataaatgttctatcattacattatgcagacattattgaaataatattcttagtattttagtattttcctttctcatttatgattttaaaagctctctcaagtaaccttaaataaatgctagatgataatctcaaatttccacacttcaataatttctctgtcagtgcactcataagtgcaacgattttaaaatgtcttttcttctcatacagtatgcataattggaatggtgcaaactcattctgtacctttggagctcgagaggctttttaattttacatccctgtgtctgtaacagaaagaagcagaaaggtgagtgattcggtaaaagagaactcagttaaagaacttagaagatgataccagagacttattgaggctcgtaagagaagtgattcaaatactcgacttccctccttcttctacgcccttctgcttcctaaattatttctcattcacacactctctcacctcacccccattgcctcttccttacctatgtcttcacatcctaaaataaaaatcttactggggccaggcatggtggttcatgcctgtaatcccagcactttgggcggccttggcaggtggatcacttaaagtcaggagctcaagaccagcctggccaacatggtgaaaccccgtctctactaaaaatacaaaaattagccaggcatggtggcggggacctgttatcccacctactcaggaggctgaggcaggagaatcatttgaactcgggaggcagaggttgcagtgagccaagattgcaccactgcaccctagcctgggtgatagagcgagattctgtctaaaaaaaaaaaaaaaacttactgggttgaattacttttttctttccacaattttgtaatcaaactcaaaacatatttcaatttaaacattttcaggaattttttaaatctgtgcattatgctccagggccccaaattagtcaaaattggaacttcatgatgctatcatttggaagcatagaaaagagaaattttacttagaagtattcttagatattatctaattctttatgaatttttataaattattttcaccttacaaattaatattaaggccttattgagagtgaattttcataattctctccagtgaacttaagttcattgtaataaagaaaaaaagttttgtaagggcaggaatgtactgaaaacttcttgaaaaaggccagtaattctaggacttccacatgagtctacaaaaaggtctcatcattcggtttctacttggcccaaacattagccttggaaatggaaataggatctcaggatagctcttaagtccctgataggaccagggagaagaaaaaaggagtgggggaaaggaacctaggcactgaccttgcaaatcatcctgtcatttactttctgatttaaatgtttttcacatattctgaaaaagaaatataagaattgtatataagaaatcaagaatatagttctgaaaggtaaatactatctagtgcttttcattttaatacaaaaaattttatagtttatactttttatacttatgtattgttatattaattcctcatattatttctgatgttgtttttatacttgattgtaagtgtcttgaaggcagagaccttggtggaaggcttgtacatacttcacaggaatcacagcgcaccaagaacatatgtacttgtatgttaagataaaataaaatcgttacttaaatttttagtgccatagagggaaattaaataattcatattgacttggggggattaactttacctatatttcagcaaataatttgaacatgtgttgagaatcttctctgataactttactcaagtgtttcttatttatctgtaattttaaaaactaaaaataacagagtataattccagtctaactttgtgtatgtagatgtatatatacacatgtatatacatatatacacattatatgtatatatatgtgcatatatatgagggaatgtgtatatatgtatatatatgcgcatatatacatatatacacattccatcatatatatatatacacactcttatatatgagaatatatgagagaatgtgtatatatgtgcgtgtgtgtgtgtgtgtgtgtgtgtgtgtgtgtgtgtgtatatatatatatatatatatatacgtatgtatgcatgtatatgtataggaatggagggaaagagttacgtctaagcacctgagcagccatttggctgaagaggactacagccagtgtggcttcttgaacttaagatcatacacttaatcagtgcctggcttaacccttaataagtcaaatctttattgatttgcagcctcactatctcagagtgtgctgtgagtggatacagtagctggcaagtgggagaactaagagtggaaaaggtggcttcactgggaaacaggtcaccacggagctttcctcatcatggtgcatacaagggaatataccccttcaggaaagcaacagtagcaaaacagagaagagtagcataatgcattcaatatgatcagacaaagaaaaataagtccgcaacaaataagaacacataactcatgaacctgactagcacagaacaaagaaataatttaaccacagtaagtctagcagatcaatataagcaatcaacatttagactaaaatgggtatttttcacactggtttatgcagtttgactgatttcacaatctaaatcaattggtttaagcagattgatcaatttcaccaccttaattctttccaaatggatgtagcttaagaatactataagaatattaaaaattatgtacacaaggtcatttcatagataactgaatgaaaatgaaatttctaccctaagatagtatgattaaaatcatgtgggtagtggcagaaattgtgtacataaagactgctctaaacatatgataccttagctgcgtatctggttctttaaagctgtccccaggcaaccttactgtagaaagtttaggggcaagttatcagtgacgcatggaggactctctgggctaggaagggactttcaggccacagtgttctcacaagttctaagaagtcattcacagtgagagggaccacattcgaagaggattgacagtttagactgaaaacagctttcaaagagactaatcttataaagtattgcaaatgaataagggcaacaggagtaggtgttcacctgccagtctccgccgtgcaagatgagagcctgtctgtacgcacacatgcgctgacttaaaaaaaaatcatataaaaaacaacatctttgctacggagtcgtttttaacaagtattacagaaagagcaccagctaccaaaaagagttgccagggccagaaggagccatcaatcgaaacagtttacatttcaaagtttttccaagaagagtgaaaacgtctcctctccttgatggaaaacggaggagctgtagtaaagaatctatttgctgccttcccagtcaagtttctttctctagagtggccctttaacccttaggttgaggccaacaggtagagataaaaaggaatgtttgcatcttctgcttgtgctctgagcagcttactaggctgtagagtcaggataaaaaatcctctttcttttgtgagtttcattgttcagaaatgagtctttttgctcttgggcactactggagataaacaggtcattttgacttttacactctgtacttcctgacatcactaacaattatacacatcagtcttggaatgtgtttttctcctcaaagtatttcaggaattgactctttcttttctccgcttcatttacaacctaggaaattaatgctaaccatgctacattttaaccagaatgtatatttgtttatctcttttaaaattttttatttgaaagaaaaaaatttggccctaggtgaaaaagcatttcttaaaatcaggaacagttttctataagatgtataatccagatgtatacttttgtttttagcttttaattttctgcttaatttttgccttatttctaaacaccaaatttgatttcctgaatccattaggataaattctacatacctcattcttacttctagaagcatgtcaaatggaagcactaatctaagaaaaaaatttgatttcacaattaagacttgggaaagaaaacaacaacagacactgggacccctttgtcatgaacttgtcccataaaaatagttatttgcgcttctccctccccttactccaataatcccatcactggattctttgttaccccatctctttgaccaacaggcagtttgtagaaccataatgaagactctgcatccctgatgatcattttttcagattgcaatgtgactagaaaaggaaaaaaatgaaaggacccccttctatttttgcacacacatataaatgctgttcattacggttacaaaaattacagtcactttcttagattgatttattgatataaatgacatgatatcactgaaaaaatattgccaatttacatataacatcctttataaataccattggttctcagtgaactcctcctgacctcctggtctgagactgtctctatgtgatgtacataattctctcaacactgatccattacttcttctcagtgttgggggttaggccaatagtgtaaagtcacagataattagcagccctatcaataaccagttacagaatttctgcctaagtgacaggccagaaaagccaaaaaaggaggtagcaatataaagtagaagggaagtgccgatatattttgtggttcaagcagctgctatggactatcagcatcaccaggagacctcactgcattagcataaattcaaatgacaaatgcacagtgctattcagagactcattaatttgcaatgggtgcagtgctcatgacatattagtgcaaaattcaaatgtctttgtagcaatgtgaatttagttgtgagaccaaagtcgctaaaatgaaaatgtgtggtttttttagcagtttattaaattatgaactgtgatgactatatccgtgcatctttttaagcagatgaggtccagcgtgctccagcggcaaatcgcatggtttgtgttgatattttcctgtcagacaatttcccaagcagcagataagataccagactgtctgccttgctccgctgcatgcggactgagagctcccccttctggacaaatgacattgccactctaaaagaaaacccagccattttttgtcttgttttcatatttttaaaaggttttcaggcaaagaatttcggtgtccacctaaagccaaaagaaaacaatttgcaattatttattataagtgacagtacatgataactgtcttcaaaatactgaagagtcaccctcaattgaaatgcatcatataattttatatgaagcttcttcaagacctcacttgcaaatatattttttaaaatagctgcctgatttatataaaccaagaatataagctacaaaaataataaaaactatcatattcatattgcttccacaatatcataaacaagcttacaattactagcattctattgtataagaaaaaagcaagaacatacacggctagaggcttttaaacaaagcaaccaagtgtatattgtattcaactctattgaatgaaattatgaacagacccagacaaggaaagtcagatcatacccatgtcacatgtgtgtggtgtgttgtgtgtgcatttttctctttaacatcaggaatcttctgtccagttacttcacattagtcaaagcagatttatcattggtgtgtcttttaaaaattggcatgttttttacatttaaataatgactcagattagtacaataatgggatgaagaaggttaatttgtctgcagtattaacattacaaaaatacacaagatgtcagcacctgcacttctcagtacccagggttcatagccacttagagcagacctgcatcccagtttatatgatctaaatattcatgttcacatctaatactaacaaaaacatacatatagcatttttcagtaaagctatagcttcccaaaccatgtaacatacctctgaatgaattgaaaaacatgttgcacttcgaaagttacttttaggagaatagaaaatcttacagtaaaagatttgccctttggccatttgagccaactaatctccatcagagtactagaagtgtgtttcagcagatctttagtaaaatttatgtttatcattttttaactttaaatatgttactgaatgtaaaaaggggtcacatcactctattactgcttatagacttaattacatactttctgagcattatttcggcttatgatgaatttgggaggaaggtcttctaatgaaagttgtgtacttttgaattacactttataatatcactgatgctttatatcatcttcagcaattaaaagtaagatcactgttatctattctacttatttgcaattgaagtggtcttgagttatttagcaggctcattttattttacagtaacagctacaaggaagacacagaattaatgaggattgagaaggatcactgtactgtacattaaacatgtggaagttgtatataactgagcaatatcagatttatcactgtagccagatgtctaggcattgtttttccctaatgaattttctttcaccaagtaattagaatcccagatttacagaatgttagaactggaagagccattgttgatcatctcccactttatggatgggagaaccaaaggttcagaaaagttaagtgaatttaccaagacctaatggttagaaaatggcagaactgaaacaagaaccctgctctctagacatcctttcccaaacttgagctcacaagcccagagggcctgtaaaaacacagattgctgagcatatttccagggttcctgattccgtagggcttcagtaggccctactgatttgcatttttatcaagttctaggcaatgttatgcttgcttgtccagggaccatgctttgagaactatcggtctctaaaccagtttttgaaaaaactgctggcattttatttctaatagcttttctcttgatgaagaaagcaaactcaggctaatacttgccacattactttgttgtcatctctctaatagagggttcgggtaatacattatgaaaagtctggaagtttgcagaaaaacaataacaaaaaggcaccctgattaaggcatctgggggcactaaaaataaaataatgtctgagcttcagtttttttaaatcataacagagtgtagttagaagccaaatataggaaagatggccttgttttctggtcccttcccccactagccaacaacatttagacaacatagaagtttacccttttagtctctaaaataaaatagcattcacagacttaattaatcaaggtaccattcatcattgtctatatagtattcacaaatttacatactaagagccagaaagaaagagcccctgtgtaaacgaacttgaactcatccgtgcctgaatcaccgactcagaagaacaggagcatgttcaagaggaacttcgccagggcacgtgctggttcttaagcccacaacacagaattcaacaaacctgttcagcagtctggtcgcacagttgtaatataatttcattttttcctggttcaaagaatgaccgtgatgaagatgatcgtcaaaatacaaatatatatatacatatttaattttttaaaaatagtatcaatttggaaaatgaaaatgactgatggtgaaaaaagattttaattatatacataaaccttgatgttcttgtgttttttctcccatttttattgaagtacagtataattacttctttttacataagactttaaggtaaattatcttttgtcagttttctagaaaaatttgatttcatattatggcttgatctcaattgatgctatcaattaaatggcatttttcctgaacattaagggtgacttcccctaagtaacatccctgttttgggttttttttgctaagttattacattaaaatctgattcaatatattatttaaactttcacagaaaataatcttttcatttaaaaataattttcaaatataaatggtttccaagcagattttactgtgcttttgccttatacttatttttctaccattatccctgtttttcagaaaagccaacccaatcacagaaaaactaacataggttttgctgtgattgcaggtgcatccagtgtgttcctgggcttacttcatgcctaaaccaacattttgtgttcactgttatttcttctaggccctccattaatagcctcctaatcccaacatcttttgccattctaggcgcttcctttctcatttctttttcaggttctgcctacgaaaaccctttaatggcttgacatttctgaattatagcaaaaaaaatgtatttcgctctgtgtaaattaaactgaattatttagtgttttaatcataatttttaaaaaattatgagtggcaaacagggaattagtttgttcagaacaaaagcctatgataacatcattcttttttcaggacaatagaatactatttattaaaaacaaacaaaaaaaaaaccctaaattctgtcctttaaaaacagtgttaagtgtgatcaaatattgtgactcagaggttacctgacaaaaaaaaacgtaatattaatgtaaacagctaaaaactaacctcctgtgaatactaaagcaaataaattataatctattatttcaggttttctgttctacaactgcatttttatttataccttttcatttcaaatgtatgtgcataaagtatttttatccctcagtaaaaataaagctagatattttctggtaaacaggtaaaacagcaactctgttttacctgtttctaaaatcttctctctgatgttttcatcacgggtatcttacatagactctagaaatgcaaaggcaatacaaatggtacgtaagaacctccattaatctttgtttcaaggagaatgtgaacattctctgtacaatttaatattccgtgtccacccacaaaattctacagagaagtgtgtgtgtgtgtgtgtgtgtgtgtgtgtgtgtgtgagagagagagagagagagggagagaatcggtaagtttgattttagtaggaaattagtaaaatatgcatattacaaataaagagagtacaagtccccatctgccatttatagtaagattttatatttcagagcttaataatgaacctccctggggaaaatttaataaagcaggttccctggtattgccagcagttgggtttttctgcatctcttattttcttactccccagggggaaaaaaatctcagtaagatttgtgagcctgtatcgaagataaatctagtgtagtctggactatacaccacccaaactgatccagatctcccacccaacccactgttcgttactgtttataaagtgcaacatgccctgtgaaatgataggttggagcattctctatctgtccttaccacaagaagtacaaaaccagtttagagtaactggaaattgcagtttcaaatttaaagaaacaccagttatgtatagggtgggttagggatgggggtagttcttaactgttcttttctcctacagaacactgagcgtctaaaacatgttcaatcctgttaatgcttgtcaaaaatttcacagttcagctttgttcagattttttactgactatgaaaaatcaatttggtgggattcagattcataaagatggaagagctgcaagagaccttaaataaccttgttctaccaagtctataggtaaaaactgagtcccaaggaaattaagggacttgctcaaggtttcacatgtccagattggaactcaagtctgcaggcgtccagtctatcatccttcccactgctcatttcatctattattatactttagtaattaaacaatttagagaagctatacaatgtgatttcacaattaacataaagcagtcatattatatccagggttgtgtagaatttcatctgtgcaaaatttcacttggtatttagtcattacactcaaatagtatcattatctttcaattacagagatcaattttagttcattagcaaaataaaatgcttgcagaaggtccacacaaattcttcaaagctgcaatcttctaaatgtcagaattgaaacacattttataaaaaaaaacaaaatgtgacaaaagtacttgaggttaaaccacagctgtgcaagactcagtgccctgcgtgatcataaatctgctaaaaaggcataattcaaagttctgtaaaggaaaatgtgtgccattgccaactaataatattgccattttccccatttcttggattttgcagcttttcaagaaagatttgggtcataggatattgtgacacaaataaagtattatgagtacagattcaacctaagatgacctagaggctgcataaagggaagattagattaatgtttaagccttgcaagaggattactatctataggcaaaaacaatggcccaaacaatatagctattagaaatgatggtaaccttatcaggctttctaaactgagagccttaattgctatccagacaaaccccagtcagctaaacagagctaccagcaaaggggcaatattatcaagtttaagttgatgctaatatccttttgataaatctgtgttgatataacttgggagaagttatttacaaaatatatataaagttgttgctccttaatatgtttaattattgtgaggttatcatactagagtttctaagattatatcgatatttcaggtttaacttgttagaatatgtaaaccaaaactacagcctttgtttttccaacatatttttatactgttgtacttttttctaaagaaggaagtgatgatttgctcatactatgatgtggccacactgatatcacagctaatgatccttgtggcacaaattaagtttgcaataaatgagattctttttctactaatatgatcagaaatttaatacccaaaaagatgaaaggttttcaattttacctttgtacataacccttttcaacataagtaaactcttcataaattttgttatgaaatttaaataatacatagtcttctttgtgattacttgtttcatggaacccaaaccctaaaattctcaattactagaaattcaagaagtttatcatgttaaacagtttactaatacagtagaaagattagaaatatcattttgtgccataccaaccaagggtagtggtattcagcgagcctggatggtaagtaaagcaggcaagcaagtaaatagaaattaggggtgcactgagagttgtcccataaacataagtgaaggctagggaataagtcaagagaacagaaatggcctttcttaaaaaatggatcatgttaggcacagtggttcatgcctgtaatcccaatgctttggagactgaggcaggaggatcacttgaagccatgagttcaagaccagcctgggcaacatagcaagaccctgtctctacaaaaaaaaatttaattagccaggcatggtgttgcacacctatagtcctagctaatagggaggttgagatgagatcacttgagcccatgagtttcagggctgcagtgagctatatgatcatgccactgtattccagcctggatggcagagtaagacctaatttcttttatttctttaaaaaaaaaaaatgaagcctggtctagcaactaaactcttgaggcaaaaattaaatattctcatttaatgggagggaaagatggacaggtaattgtgagattatcaataagtgtgcactgaaagagcattgtacccagcaatcaagtctccaaggaaaagaactgtgtgtgtgtgtgtgtgattgagagggcagggggaggcactgaggaatatccagagctatgcctgcctttgagggattgaagtcatcctgttttgaaggaccacttgagtgagccccaggaaagttttctgctgcatagactaacagatggaggaaggccagagctcaataacagcagaacacatcagtgaaaagcaaactaactgatggcagtccagtcacaaagctgacacaaggctcatctgtgcttggaagtactgttggagaagggcttcctctgggtttgtaaaatcccttaaattcttagacaatcttggaaacagactggccccctaagtatgcaatactatacttctggccagcatggcatgtggaggcttaagccaatcctactttaacctagcaaaggaaaaactgtgtgactgtccttgcatgcagagcctggggactgctttatcccaattacataaatactttgttgtgttgttgtctcttctgttttaaaaataccactactgaaggtaactgctacctgtgcagatgaaatgtacaataaaatgtacaatgaaaaccccattgtacagctctcaatccattttacatttttacctgcacacctagtcatttggattatgatatttacaactaaatgctttatacaaaaaaaaaccctagtattgttgatactcttgatcgtacactttatttcataaacaaatccatgatattaggaatgctgatggtgaaattgtccttaatgttgctattatttagaaattttcagaaacgtcctatcgtttcatgatatgtttctcaatgtcctgcgttgttcacttatattcatcttttacaaagaaaacagaattaagggaaatgcttagagatatataggttgtcttaatttaactcacagattttttaaaaattcaagcctggggtttagaaaacaggagtaactaggaatgaagctctccatcaacaaaaacttggagtgaaaaataacaggctatcttgaatagcttggatattccatttaaggccaagagcctaggaaaaaaaaactccttttaaaattattccagtttttgatttctcaaatgacacatttatgtacttgcattaaacagcaaacattacaaagaactctaaattatcagttggtcaccctaatgaaaatccaaatcagttcccaagggtaagcactgttaccagttactggtgtattcgtctaaactatttcctatatacttacaaagatacatagaataagtgcatagttgcctttatatatacaattagtacatgaaaatatggtattatttgtttggtttacatgaacagagagaagatatcttttaattctaagagtacataaattaattatactgagaaaaatgaaacattttttgcaattattggcctagaaactagcactgaattttgcttctgaaatagcatattagcaggagcctcttctacctaaggaggaaaaatctgctttaatagccctttcatatccctcatagcccagtgacagacagcatatatttagcttcactctcttccgcaaaactgaaatgttctgctcagattttgttataaaacttgtacctgatgaacctcaaggcaagttgtggaatcacataccatttttgtccagcaacccactttactcatcttttattgtcattgcttattaaatttgcaacacacacacatatattcatacacacatagagaaaattaaaccctacacttcttcccttgagagaggaaaggaaagaaaaacaggaaagtcaatattcaatatttgctgtggttaagtatatatatatgtatatgtttatatatatatatatatatatatatgtttccccttggaggttgctggatagaggatgggtttacaaaaagtttaaataaatgatgagttcctctaagacctccagagacttcacattttttaactctaatatttgggggctgttcgatttgatgtttgatttgaaatgaaaaggtttaaataaatgcttggaaagtatactggatggcagtatttagcaatcttgttttctttacataatgtaacacactaatggactacatttttctttgctttctgccgttaactttgaaaataagcaagttactatccaaatcagagccaaaaacaccacagggtttctggctgcgaagggacacttcatgcacaaatgtgggaaaggaaaaagttgataaacagccagttgggaagtgtgaagagattatttttatttcatggtgttttcagtgtgtagtatctcagatgttcaaaaatatatcactatgcctgaaagtttacaattcccatggtagatattatctgatgtagtagcagatgaaatacttataatggggacactctccctcaacctctccctctcttttcttctctccactccaaatctaacacagttaaaataaagcttcatggaagtcaagcttaggcacactgggattttaatgaatgagtccatgagatgcagctcttaaaaacagatgctgtccctctgctgctgttctctcttcttggttatttttatttctttcccagtcaaagaggctggtacgtcaggatgattttcctttgctaaccatcctttttccaacatttaacaccaaagtattatgttcagacctcaaggtttacaatgatagtgtttgaataaaactggtgggaaaaaaacttgaacaaattacaatttgcattctattgttgattctgtagaattttaaaatgtatatataaatatacataggagagtaaacacacacatacaatcagaccacactgggtctctaaaataatcaagattaattatctgatcaaagtgccaacctataacctttctgtgaggtttctagtgcatgttgcacattttcttttacatgaaacattgcctgcactagtcttgctcattagttcattcctctcattgtcattgcctctaattattttattaattatgatcttgactttaatatttatagatcatgccagttttataacacaggaaatgtttgaaattaaataaagaaaaattggaatttctttaatttaatcaataaaggtgtatcacttgggagcataaatgggaagttaatttgtttcacaaaataaatgtcacaataatggaaagacaaaaattttaaataaaattctctgaatagaggataaagtaaagaatattttcctctgatgtcctgtaataaatgagcatggaaatataatcaattggccctggtataatcatgattataaattgtgttttttaatgtgctccaatattttgtatatatgcatcccccaaaaaagctatttaaattaagcaaagaaatttatcatatacgagctaaaaagtatacacatgtatagaatgttttctgttgataagtaataaatctgttgaatgaacattccaaaaggcagaaaatttttgtgaaactaggaaacaattaaaaaccaccatttaacataatgggtggcaattgcacggataactcccccaggtattccatgcccactcattagttgaaaagcaaaaaaaaaaaacacccaggatacatcttgtttcttggacccttcatccaaaagaaaccaaagcaaattacagtatttccaatttaatttggaagctagtcaaccctctgtttaaacttctgaaataatattggtaaaatagtcagaatcacagactcctatctgctagctttccaatgacatgtggttcttctgttcctatgcaaagaagggatttatttctagtaaataagctatttcgtgggaaaaaataaacacaatttcgtaaagataggaatattgcatagtaggagacaaagaaaaaagcagtgtgtttatatcatatgttttaaagtagtttctttttaaattagcaatttcatatcaaaaacaggaaaataacacattcataagatatggaaaaatcagcttctgaggaatagtagtatttggcaaatacaaaataaaaaatactgtaatgtctgcttttgtaaatgttgaagattagtaaactcaagataaacttcagaaatgagagagactcagtagcactaagagaaatataggacccagagaaaaatcttaacaaaacttcctgcccattttccttcttagttttactgaataaacaaatccattggtggagtaaggagctggatgttaatgcttcctcctttagtctgcctagtttaggagtaggcaaacaagtgttagaaaatctctgagcctcaaccttttaaggaaatggttctcagcatcgataaaacacccacaactgcctctctttcacgacctccttgagaatacccttaaaggtatcctgctcataaaactaattccatggttcctcaaaaagtttaacatatgacccagcaattgcagtcctagggatatgtcccaaagaattgaagacaggatttgaaacaaaaatttttacatgaatgttcataacagcactattcaaaagtgtcaaaaggtggaaacaacccaaatacccatcaacagatgaatggataaacaaaatgtggtatatccatacaattattcacctgtagaaagtaatgaaatattgataaacaacatggatgaactctgaaagcattatgctaagggaagaagtcagacacaaaggccacatattgaatgatttctttcatatgttatacacagaataggcaaatccacagagacagcaaacagttcagtggttgccaggggctaaggagaggaaggaactagggagtgattgcttaatggatatgaggtttccttttaagttaataaaaattttctgggctgggcaccatggctcatgcctatataatcccagcactttaggaggccaaagtgggaggattgcttgagcccagaagtttgagaccaacctacaaaaattttaaaatgtaaccaggcctggtggcaccaaaatgtggtatgtggtcaactggtggtacatgaaaccactttaagtggtaaacagcaaacattaattttttttatctatcatgtcaaatttgtaattttggaagtgaaaaatacttgttttaaaataaatttacttaggtaaaagttttaattgacttaaagaaaacaattaagcaggccaggtgtggtggttcatgcccataatcccagcactttgagaggctgaggtgggaggacttttggacccaggagttcaaggccagcctgggcaatatagcaagaccccattccacaaaaataaaaataaaaaaatagccaggtgtggaggcatgcacctgtagtcccagctacttcggaagtgaggagagaggattgtttgagcccaggaggtcaagactgtagtaaaccatgactgtgccattgcattgcagcctgggtgacagagtgcgaccgtgtctcaaaaaaaaaaaaaaaagttctgtaccaacatcggtactgatggttgcacagcattgtgcatgtactaaaagccactgaattgtatgctttataatggttaaaatggtgaattttatatgtaaattttaccccaagtccaaaaaaaaacctaattctagcacacacgacctggcccagagccttcagggttgatgtgcctggccaagagaactaacgaccctggcaggtaagactccttgcatcagtcctacaaggtgcactgtctttaagttgggtaaaatttctgcagcaatgcctcgatgctcaagtttactcttttaaaatttggcagttatggtcccaaagataaaaactccaatgtgttaaacagtaggcattttcaagaaatctggattttagaatattctttccaagttcaggacctacttttagctctttggccattagacaaaagaaattttaaagcgaaaataatcaatgacttccttctagggtatccatctaatcagtttcctggaagacttttactttacatctattaccttactgtaattattaatagtgtgcctaccactctcaactgtctcagtctggatgatcaattatacagtctccctacttcgaggggaccactgtaaagcttccctatcttttctatccaacaggaatcttatttgtgccagctttgacccagttatctggcaagctagatgggatttgtcttaatatgtgcattctgtttgccaaggcatacatagcatgtttggacacatggtctcattttataatcttttgctcttatttattcttcatactctatggtagagctaatcatttgtgggaaccaaaatgttaggaatagatggcatgtcaaatgttgccatagcagacttttctatgggacatacttttaaaaataatccaaaaaaaagttttaaacttaatttgagtagcccctggtgttattgaatggtagtgtgtgaagtaaatctgggtgaaatttcactcacatctactttctgggatcaagtcctatagataattccatagttatctccctatacttatgaacatccctctaggtaaaaagcagtcatcttaaaaaaaaaaaaaaaaaacctacgcatagtctcaaaatttatcttcatacaagattagatcagagaagtaagtgggctgagaagactgaaatgggctgagaggttttcaaaatagattgccattgaacacatcaaatttaatacattcctcattcctcttaaatagcgctgtctgcttcttatatcctacatctagaaattgcttacttctagaaatttggtggcataatggtggcatacttcaggatttgaccatcaaagtcatcccaggcaaaaattactcaggcaatactttagttgggctactttgattacaacagaggctcacacgagccttcttaagagaagggaagtttactgtgaaattacccacaggcttaaagaaccacttaatggctacatcagcctctcccggggtaggtggtcataattactgctctcctttgcttattcaaaatgtatgcttcctcaacactttggtttcctatggctcaccatggtgccagctttacaccatagcatcctctcagcttcagctcctacttctttccatttagttcagataagtaaaggagaatctgattggtccaactcatcgcatttctgcccttgtttcagattaatcatcccttttccatccccccaaccaagttaaactgttttggccaaagaagaaaggccggttatgtaatacagttaaaatccctatcacctccctatcatcagaggttttaagcaagataaacttcaaaactgagagggcctcagtagcaccaagagaagtgtaggacccagacaaaatacttaaccagaagttcctgccaaatttcctactttgttttactgaacaaataaatccgttggtggagttagggttcagaatgcgagattcggcatgcctagctggggcagttaggccttcgtattttcctctcacgcatttcagtccatctccatgaaaaagtagttccgtaaaactgcccttccattccattccaattctggcttcaaccttccctggatctcattctcattaacaattacttttaactagatatcaaatatttccaacataaattgttaactagtgacaacatgatgctacttccaggaaattaggagattaatctcttctcctgtttctcagaccttcatcttccaaaatgtttattgggaacatagaaagagaacaaaagatagcccaaacatgcatctctaatgatacacatgcctttatcctccgtactcactctgacgcttccctgtgcttatttcacgtcactctcctgaaccttgactgctggcatgattacatttaaattagcaactcctaacagctaatgccaatatagtcgtaacctatcagtactattaaagaaacatttaggaacaggaatttctgccaagcaccccaattacatcatatttttatttactaggtcagctcaggattttcttgcttttccatttaattcaaatcaatgcctaatcaaaacacattatgatttatgtatatatttccatgacactgcttcaaagcacaaagcttatgtaataaagtctgatttttggaaagtattttttaaattacaagcatgaaagtgcgtattttgaaaaacctttctgcagaaatgaaggccagccagctagggataaaacattgtagatctttgctgcacagtgagaatagcagtttctacaaaattttaaaagttgaataatacttactaaaagacaacatagcacaatatagtactatagaaaatgtatttctttaataaaagctatctccttgtcctcagagtgcctataatatgttgatgggtcctcagtattatcatccttgttcgggttctgaagttttcaattgaataactttttcagagacttggggaaaatagtgagcgaacagccctagaacgcttctctgggcagaaaaaaaaaaaatcccatgaaatgtaatgtgttaagaaaatatctttcttatctctctagtaccccaagcgagcctgtctaattctcccacttgtctgtgtagggatcatgccagcagccaaggttcaggagagtgatgtggaataagcacagggaagtgtcagagtgagtacagaagataaaggcacacctatcattagagatgtatgtttgggctatcttttgttctctatgttcccagtaaacatcattttggaagatgaaggtctgagaaataggagaagagattaaagatgtcaggcaagggaaaggaggagaagcagataaaaaaactgacatcccagaaggtggggattttcccttttctgggaagcaaaaaaaaaaaaaaatcctctcaagcaaatttaacaccttcatgaatataattaatttattatcacttaaaataaaacatagcaataaaaactcaggctaatcatgtgcaaaagttactgttttcagacacagaccatgcaaagtcctcaagcttataaaagattacattctggaacatgagctatcagataaaattactggatcttgattttttaatgttataaaggggcagtggggcgggggggcagaggtgcatgttcttgcctaaagcctaacattaaacattttgtaagcaaagcagaaaagagctctttagtacccccaaaatgtctgttttagacttgtacagataaaaactttctaaaatattgaacagcacaaagtatgaatcccagctctataatttttctagctatgtgacctcaggcaagttatcctctcagactcagtttcccgaattataaaaatggaataataatggcacctatctcatggggtattgtaagagttaaattagataacctatgaaaagcactcagcaatgcccagaaaagtgtatgcgctcaataaaggttagttgttgttagtagtattatgtgtaattattaataaccaggctcatgtcttgccactcatcctgtaaactgccctggttcatcaaaccacattgcagcccataagtcccagacaaaaacatcagataatgccattgtatagaatcctacatatttattcctgacatcattctaattcagtcactcctcttcactcctccacctgacttgaatcatgcagacagcttccaaccacccccatgtgccttcttcattttatttatttatttttatttattattacttttttatagacagcgtctcactaatgttgcccaggctggttttgaactccttggttcaaacaattctcccacctcagcctccagggtagctgggactgaaagtgcctattaccactcctgactccatgtgccctctttagctccagcccccattctggcctccatcacttcactgggacctgctcaagctagctgtgttctctgtaccagccccactgcctcagtgaaaagattagatcaccttaataaatcatctaaaattacttaatacaatccagtataaatgtataaaatgtaacatcttcataatttccccttaattcaattaaatcttgattcttcccttactcctctccaaccaaaacctgttccttcctgagacctcctcatttcagtaaaaagcacctctagcacttccccagaattctaaatgttgattcttttcttttcttactccctaaattcaatccattggcaagttctatagtctcaactttaaaatacatcctgaatctttccccttttatctccattactaacacctttgtcctttgtagaatcagcatcagcacaacctgcgaacatgggcgccatcccacttgtattgaatcagaccccagggggaagaagcaggtctatcagcttgttcagccctcccttctggtgattcccatgaacactttcatttaagaaccactgctcccatcaaaaccactgccatttctcccactgggaatatcacaatagccttctgactcatgtccctgacccgactcttttgctccccaacaatccattttccacacagcagcaagaataacattttttcacttaaaatcctccaatgacttcctatgtccattaaactaaaatccatttttcttgctctggcttacaaatcccttcatgagctggctacatcctacttttccaactgcgtctctctctagcatcttttacgagctggtgacactggtcttctcttgccattacttgaacatattctggtttctaccacagggccttggtaaaaacttgctcttctgctgggatcattcttgtcattgggatcccaacttcaacgtttgctcctcagagaggtcttcccattatgttatttaataagcagcttctgggctccaataagtcatcacaatcagatagtcaacattcattctctaagtatcacttactgtgatctcataactttcttatttgctaatttgagatctattatctttcttctactagaatagtctaagagtaaggacctcattcattgtattcactcttgttcactcagaaactacaacatggcctggcacggtggttcacgcctgtaatccctgaactttgaaaggccgagccgagcagatcacctgaggtcaggagtttgagaccagcctgaccaacatggtgagaccccatctctaccaaaaatataaaaattagctgggcgtggtggcaggcacctgtaatcctagctacttgcaaggctgaggcaggagaattgcttgaacccgggaggtggaggttgcagtgaactaagatcacgccactgcacagcaacaagagtgagattccatctcaacaacaacaacaacaacaaaaaaaaaggcagaaagtacaacaatcactggcatatgtgcaccaaatgtttaataaatattaatatttaacaataattaataaataaattatttattgaaataactcattaatttaaataaagcagcagaggaagaaatattttcagcagtttcagggaatttggaaagtcttctttaagaagactgtgtcccgttaccctgaaaagaggcagagtaggacaatggattaaaactaagcttggaatcagatcaagcagggttcaactcctaggtctacctcttacaacacacaaaaagtatctcttttttttaacttgttcaacttctaaagcaattttttatctttcatttttttttcatttgttttgtttttggaacaaggtcttcctctgtcacccaggctggagtgggtggcatgatcactgctcactgcagccttggcctcccagactcaagtaattgtcccacctcagccccctaagtagctgagactataggtgtgtgctactgcacccagctaactttttattttttgtagagacgagatctcacaatgttgcccaggcttgtctcaaactcctggactcaagaattcctcctgcctccggctcaacatcttcctctcagggtcattgttgggattaactaaaatgatgtaacatggaacatcacatatagtagatctactctgtaaattataccttgaaactttaaagaagatttggagttccttgaaaaatatatgtgtcgtatgacaatataaatgtaaatcaaaacaaaataaagaaatagttcaccctataatcttgtttccttcaaagaaaaaactatttcaccttgtcatttccctttcacatatacatacaatttttttacataatgaaaatcttaaaatgggttcaattttgtaatttcttgcctttttgaaaacccaattcaaaatgtctccttttctgtctctctctcttttttttttctcaagcagacaaagtgatcaagttgctggtttctcctgcctttgaagccgaaagtcttactaccttcttgtactgctctctacattagcaatttcatcttgcactctgatattatgaatgtcatgcctttaaaatgcatgaaccaacccttatttgcactaaaaattccaagcctttgatcattcctcatccttttgctcaaaaataactgctccaggttttgacttgaataatggtcaactcaaaagcacacatctccatgtttgatcatgaatctgcaaaattaaaagtctttgttctcattggagcaatgctggtaacaggaaaaggagtgaatccaggaggcagatagaagttggaagtcacagaaatatgatgagtatcatcattctggagacagcctaaagtgcataagttgttggagtgcttgtggccactctgagtgttgtgaagggatgacataggtacaataaggaaactattgtaaactaatagattttgaaaagtaaataagggaaagtgaaagtctccaagtttacaatctatccaagtaacattaattgaatgcttactgcatgccatgcaatgtgataaattctggaaatatcatgatgattaaaaataaataagccaggcagggtagatcatgcctgtaattcccagagctttggtagaccaaggcgaggggattgcttgaggccaggagttcgagaccatcctgggcaacatgacgagaccctgtctcgaaaaaaaattttaaattagccaggtgtggtggtgcatacgaatagtcccagctactcagaaggctgaggtgggaggatcatttgaacttaggagtttgaggtttcagtgagctataattgcagcactgcactctagctggggtaacagactgagactctgtctctaaataaataaataaataaaactgaaatctgagcatagttcctattcccatggactttataacctagtataggaaataacaatgattccactaaacacttaagtacacatcagtttacgactggtattatcattggaaagaaatgtgtgtagtattataaaatcatgaaaaaattggacttcacctgaacttggggctcaaggaaggcctctctgagaaaggagtatttgatctgagatctaaaagtagatgttaactaggtaaatgtctatgagttggggtttggagggactgggagtacagagcattccagacagagagcacagcatccacaaaggccctaagtcagaaacaacaaggcctgttgacagaactgatagaaaaccagtatgacaatggctaaaattgctcagaaggtgagtcagagcaccatgcaagtcaacgttgggatgtgtctaaatcagtgatagagctgtaactcacaaagtcagctgtgaggattaaagaaagaaaataagataaccttggtaaggaacatagtacactgcctggcacaaaccaaagctatttgtaagtgttccctattcttattatcatcatattcattaccatgtctacttgctcatacattagccatttcaacttttctgccatcttaccaagtcaggtcaggccactattgttcctcacatggatcactccaatagcttgctttcaaactcattctctacactgaattcttcccttcccacatgaaagcatttaatgattccacctctggttagttgtgtataattttggctttgaatatggttcattgtgtacaatgcttataaggttaaaagccagacattatttataccagtcaaaatacatagaaaataccgtcattaccacccaagatagtgatagagatggcttaaatattatgcgcttaaaatgccaggtaaaattaaaatatcatccagagtaattataactttaactaaggagtcacctgtcaggtaggatctccaaaataccaaaaactatattgagtggggaaggtgaggctgcatctgctcagtggaagatctagggagagctagaaataccagctggagcctctgatcactttaaagtacagccttcagtaaaacctctccagagtgaagttccgttgacagtcatagctctctgctcccgccaaccaagtctagagcaccggcccaactaggaccccaacttcctcatcaacagtgtaagaagtgaagctgggagagccacataagcaatagaatttctaattaacagcggggcacggtggcttacgcctgtcatctaatcactttgggaggccgaggtgggcggatcacttgagattaggagttcaagaccagcctggccaatatggtgaaaccccctttctattaaaaataccaaaattagccaggtgtggtggcacacacctataattccagctactcaagagagtgaggcgggagaagagcttgaaccggggaggtggaggttgcagtgagccaagatcatgccactgcactccagcctgggtgacagatcgagattctgtctcaaaaaaaaaaaaaaagaatttttaattaaagacccaaaaagtcttctctttttattttgaacttagtcctggctagcctgtaggtaaatacctaccataataaaggaacttaaatggcatagtctgcaaaaccaagagaagtacaaacataatagagtcaccttctaaataaaacccttctaatgattcacattgccttaagataaaatcactccatgtagagctttttatgatttattatctataccctctgaaattcctccaacctcatctctcattacaacccacactcactcaacactccaaacttaaccacagcttttgaaatcccttgagtggactatgcaccagctcatctttgggtcttaggatataggctactctatctgcctagaatttcttccctccctgctaccaattcattcttcaggactcagctgagaaattatcttccatggccgggcacagtggctcatgcctgtaatcccagcactttgggagaccaaggtgggcggatcaactggggtcgggatttcaatgacagtctgaccaacatggagaaaccccgtctctactaaaaatacaaaattagccgggcatggtggcgcatgcctgtaatcacagctactcgggaggctgaggcaggagaatcacttgaagccaggaggcagaggttgcagtgagcctagattgtgccattgcactctagcttgggcaacaagagcgaaactctgtctcaaaaaaaaaaaaaattatcttccgaaagatgcctgtcctaaataccctatcctgggttttgtgtctctcctaaatgttcccacagcaccctgtatctatgcttagtaaaccactgcctgtttttgcactccacacaaccacactagattgtgacctgcctgaaagaaaatacagtgatgtcttcattcatctcttttttcttttttgttttaaataatttcaactttcattttaaattcatgggatacaagtgcagacttgttacatgggtatattacatgacactaaggtttggagtacagatgatcttgtcacccagtagtgaacatagtaccctacaggtagttttttaccccatacccttcacacactctccctcaaccccagtagtccccagtatctgttgtttccatctttatgtccatgtgtgctcaatgtttagctcccactaaataagaacatgctgtccctgtgatttttgcttagaataatggcctccagcctggatccatattgctgcaaaggacgtaattttatctttttatgactatgtaatattccatggggtgtatgtatggcattttgtttatgcaatccaccatcattgggcacttaggtgctattgtgaatagcactgggatgaacatacaagtgtgtatgtcttttttgtagaacaattgattttcctttgagtatatacccagtaatgggatggctgggtcgaatggtagttgtattttaaattctttgagaaatctccaaactgcctttcacagtggctgaactgatttaaattcccatcaatagtgtatgaacattcccttttctccacagtctcagcagcatctgttattttttgattttttaataatagccattctgactggtgtgagatggtatctcattgtggttttaattcattcaccaaattgagagttttctttattcacagtagtgaataaaaataaagtccctatcctcaaggagcttatatactttatttagcttgtctttccagcaggtagcagcacatagtaaacaatagatgaagagagtttgagtggataggagttgttcttgtcattgttattagttgggaaatctctgagaacaaccttgcccagggcaggagagtttagaacatttactttgtttataatatttatttattttctggttattgaaaactatattcagtatacaaaattatatatatatatatatatatatatatatatatgtcgaaagaagtgagtagaaactcagctgaaaacacatatgaaacatttattgatattttatgttttcttgctgtatgtttctgtgtatgtgtatatgtaaggatatgtacagttcttcaattgctttattggaatataattcatacatcatacagttcacccatttaaagtgttttttgtatgttcacgggatggtacaacaatcaccacaatctaaattctagaacattttcatcttcccagaaagagattctacataccatttaattagcaatcacccccaacattgcactcccttgctccaggcaaccactaatctactttctgtctctatggatttgactattctaggcattttatataaatggaattatacaacatatagttttgtgatttgcttccttcacttagcataatgttttcaaggatcatccatgttgtagcatgccagtactttatttatttttatagccaaataatatttcattgtgtaggtataccatattttatttatccattcatcacttgatagacatttgggttgtttccactatttggctatcaggaataatgctgctataaacattcatatacaaggttttgtgtggttgtatgccttcatttcttttgcttatctgccaagtagtaaaattgctgggtaatacggtaactctgtgtttaacattttgagcaaataccaaactgttttcaaagtggctataccaatttatcttcccaccagcaacaaatgaaggtttcattttctcctatatttcttaacttagggaagttcttattgtatataggtaagattttactgtataaagcagacttaggttctgctttacaaactacacaagtgcttctctcttataaaagaattacttgtaatggctgtattagtctgttcaggctgccataacaaaatgccacagtttaggtgatgtaaacaacagaaatgtattttcttacagttctagaggctggaaagcgcaaaatcaagtttccagcggggtttagtttctggcaagggctctcttcctggcttgcagacgggtactttgtcctcagatgaccttttctcagagcacatgcctagagaagagagagagagctctggtcgatcttcctcttcttataaagacaaaaattctctcagattagagccccacctttatgacctcacttaacgtttattacctgtttacagtccctgtctccaaacacagtcacattaggggttagggcttcaacatgtgaatttagaggaggacacaattcagtccatagcagtggctaaaaaaaaatggtctgttgcaaaattctatatgaaaatgatgctctaggagcacgatattaaagtttaaaaactttttccttaaaatatattatttgcaaattttctttaaaattcattttgttgtgttagctacatacccttcacgtccaagtgtggataaaagtgtctttctgaaatttctcacctgcatctacttgcaatctggaagaacagacttcacactctttcaaaagatatttaaattttctgtgtagctcaactgttgttgtctctaactccatttctatgctagagaaaatgatgccttttacaccattgagagcctgtataatcttgaaagttttcatttgaactgatgaaggaaaagaggccatcctagagttagctttattggaagcttctactaagcaaaacttcagatttccaaaggaaactaattggaaccctgaagcagatgggaaaagcagaaatttcggaacacctcggtgacctcattacaagcataatgaaggaggcaacgatggagttaattagaagagaggcaagaaaaagattaaatgagagtacaaaaaaaaatgtaactcagagaaagagaggcattcagcaagaaatagaatatgctgatctctgcaaaactattcagaaccgagggagatgggagctagaatcaaacaaaaggcatataaaccaggtggccactgaggatgaaaagtctgtagaaaacacaaagagcgggcacctgggaaggaatgaccagatatctgcatcaagcagaaaatatagacttggtagccaaaggaatttagttagttacacaagaggagtcgttcttaattgggtgacactgattgtgtgcttgtgtgtgtgtgatggataaaagtcatggatttcttaatagtcacaaatagatattagtccaaatttgtccattgccacttaaggccaccttaaactgttaacatctttaccactttctagcctaagggctattactccactatgtgtagagaccaaacagacctctaaagatcattattttcataagcaatatttgcccttcagacgtaggctgcagatggtaaattttaaaacttgtccatgaaatggcattttagacatgtagtttgtccatttgtttatggctcatactcattttgagaacaacaagaagacagtttcatagctctaaaattcacgtgtgaaagtttgttgcaagaaaagaataccatgctttctggtccaaatataattatgctgcttgtgtagactggaggcttaaattgtaagaaattgtagagacaggatccagaaaatattcagttgacacagactagcttctagaaagttcagctccaaactttatttccgaatcatatagattagctagttacaatgagcccacagattagaaatttaccacatattttctttatttatatttgaaataatccaggtctacaggctgtggttgaattgaacatgaaaccgcaagtttgatttgctgtagttcaccttaaagccacgtggtgatacatttatggctccaggttttcactcatgtacctcccccagagatgtcaccgggcaagcatcaaattggactaaccagtcatttttgctctagtcctacagtgatcaagaatgtaagatttcttctagctcagcttgttacatgaataatgtagaaggtacatttctcacatgtatcatatcttcaaacctcttacagagctatattccattgtatagataaattaaaagttaatgcttcaaacttcctttacagcataaaagaagaaataaaattttaaaatataaacaaagaaaaggggcaagttattttgaatgtgatttttggacagttgattccaaataagaggaagtaatatctcatcagaactttggtaggaatttatactactgcagcctacttcatttagctccatcatggcaattgtttcctagtaactagtcttcccagcaaatcagaaattcattttttaagcatggtctttttagttcactaatctctttaattaccccacttcaacccttttaactctctatctgccaggccaattccaaagcctaaaacttctaattattctcttctatttcctctgccctgttgaacagaagtgtttaacagtctgacttctgaaaaaagtcagataaccatgttgattggcttctacaaacttctacttcctgagttttctccaattgcttttaacttccaagtttacagtaaatgaataaacagtaatagctatccaattgtgagctctggagtcattcctatctcatccctttttaacccctcccctcctgccatcttcactgtggtttatgcttgttaataatcttggctccttgtgaagattccttctcttgcttagccacttggacttaaactgtgctttgaactgtagttgtttatatttggctttgcttctttgatggcactcgttctttgaaaaatacaacaatattcgctatttaaggataggtcttagtcacctttgattccctcactcaaagatataatagcagccactaaaagatatcctgtccccgtcacctaaccaagttcttcttcttcttggctccttccaggtagggagcaactttgaacatcattcaaccatattcaggacccaacactgttccataacccttctacaaattcctgaattgtatcaagtttccttctgtgttcttcccaatatctaacattctctggagaactgccaagcactcccacccctcatttgcagcatacacccaactttatcaatcagtccaaagtcattcaacaatattaagatgcttaacttcttaacaattcaagggcaattatcaatttctcaagagctgagtttggaaatgccactcacaagattctgacaagcatggtgcagacacaaggtggactccaagcctaagccatttgtctggagatctgctagttaaattggttttatttgaaaactaaatgggaaaacctaatgaaggaaatggtatgaaagattaaaggcacaaaggagggaggaagtttacggataccaaattgagttcatgagaatgctggaaaatattgtatatactgatcaaatgtgtgaaagtgatatggtttgactctgtgtccccacccaaatctcatcttgaattgtattcccataatccccatgtgttgtgggagggacctggtgggagataatttgaattatgggggcagtttctcccatagtgttctggtggtagtgaataagtctcacgagatctgatggttttatcaggggtttctgcttttgcatcttcctcattttctcttgatgctgccatgtaagaagtgccttttgcctcctgccatgattctgaggcctcccctgccacgtggaactgtaagtccaattaaaactttttcccttttttttttttttttgagactgagtcttgctgtgtcgcctaggctggagtgcgtgatctcgtctcactgcaacctccacctcccgaattcaagcaattctctgcctccacctcccgagtagctgggattacaggcgcctgccaccatgctgggctaatttttgtatttttagtagagacagggtttcaccatgttggccaggctggtcttgaactcccgaccttgtgatacacccgcttcagcctcccaaagtgctgggattacaggcgtgagtcaccgcacccagcctcaaacttctttttcttcccagtcttggatatgtctttatcagcagcatgcaaatagactaatacagaaagccagcatcaatcactagggaaagcaccagaatagacaagcaacagggagcagaacacatattccagggtgacaaggcaaacagagtagggtgggagtgaaggcatgcctttccttatatggagctgagatgtggtgagaacaatgcggtgtgatgacaggagtagaatgggtgggaatgagtaagccaagaatggagtgccaaggcctttgctctcacagaagaggggaagaatggaaataagaccacattattaacagattgtgctccacttttaaaataaatctaaaattccattgttgtacattgacacactcttacacaattagttctggttctattttaaatcagaattatatgcttggagcaagtatgttctatattacatttgaaagtttcctgtacgaggagcacacttggtgatgagggaaggaataataatacaataataatgccaccatttatttatataaagttttatcataatactttttggcaaaatacttatttaattgtataaaatgattgtatgtgatatataatattttattgataataatataataatgaagactgtataatatatagtataacataatataatataataaaaaatactgtaacacatttgtctccaagcctttactaaatccttgccttcttccctcgactccttgctaggtttgacgttgttcacgttcctcttcatctgtaattgaattgtacataagagtactttacattggagtactttcccctccgcccagtaggggtcttgctttgtagttgctctttgcacaggtgagaaaagaaaccagccctttcgccactgaggggactgctgctttttgcttttttagtcacattattataagagcatcagtgttcagggacatattctgctcatttatctaataatctctggaagctttcttaaaagaaccagagctcttagtgcagcttcctgaatgtgatcaggtaaacatcagttcaaattttcaaatctcaaaattatacagaggccaaggaactagagaatagagaccttctcattcagttcccccagagaagaatatcaaagaaagataggctgcattgtgagtaactcaagttcataggtagacagtcaccaaggaaattttcattaaggtttgatgccaaggaaagccatagaatagcctacaggaagtattaggtcaaaaccctatggaagggagacaagatgataagggacagaaaggtgtaaaagaggaagagaaggaagaagaaaatggtattcttttttaaaaatgcatatgataccacctacatgtaaaccacctttacaaataaagtacatctgaaaaaggcccactcttcagttagatcttagataacctcttatctcaatggcttacttcactcccacagttgtcactttcctcagagccagggagatctaagttgtcaactaatagataatgtaagattacttagacgtcatgtaagcttttagccacacagaaatacaatgttatacttctttttcaaggctacagggtttagtcaaaccatggtttttggggaaaacaagagtctgacaaatgtttgatgattacagaatacatgatcctttaagatgtgaaatctcacaattatgacattttaaatgactctacactcccctttctgagaatacagaatataatctcagtttttgcaaaatgttttcagtgcgtatatatgcatttgcttatatacatacaaacatatatacaatatatcttttgaaatatgatggcttgatgtttaaagttttctgacactaaactggattttattttgaatataatcctttataatataatacagtccttttgtttcagtaaattcttttcttcctgttttcaacatcttaatgctacattatgagtgcaattcatactgcaatagagcaacataaggcagtataacacaattagaaagcacttgtcttgttggctctaggtctgaaaagaaaccgaaaaacaaaaagaaagcacttgtttgctatagatatagcatcaatgtctctgaaagagttaatattacttccaaaatactaagccagggacagaggaaagcagtgaaaaaattggttcaatatgatattgatttgtggaattcttgagttcagagcaagagttccccacttagtctatagatccaatctagatattcctggaatacatagttcaggcagagctcactggagatctagcaatataaacactaaccaaattaactctaagatactttagatacttgttcgtaaacaatggtaccagtgcactcctgtgtactcttagaccttcccatactatccatcaagctgtgaaatgcccagacatactccagccaccaagtaaaaatggatggcatttaataaaagcaagtcaaagttaacattttgaatcaatttctttccctaatatagcagcagagagtgatttaaagcaaatgttttaattatgcatttcctctggccgatcctaatctagcattaaaacagtgcctcctacaactttgtcactcccacctgccactgctaatgttgtagttgtgtaggcataacctatgtgcatttaggtccaaatttaaaatattctggaagttagtgttcctttccaatgtacttttctatatacaaacaggaaaaagttaaatcgaggcaaaaatctgtaactctaaggacactttgtcttaaacattttcctcaccatttctaatcatctttataaaactgttttgtcaaataacagcagtcaaatttttacagcagtcaaattcttaaataaaaatagcagaaaattataaagaaataaagaaatgaacaaacagctccttgctccaaatgaaaacatttcctattatattccgtcagtgtagttatagcttaaagatataaagggagtgtccaaagtagtgtgtaaacaataaatattatctaaaaatgaaacatactttattagctgtttagggctttctatttcttctggctaataaagtggaattcaaatattacatttgaagctgaatcataaatccatcaaagagcttattttccccaaatcccaacttcaaaacatacggaaaattgcctaaaggtagagaaagttgttgctcttatcacactgtgcatgtaaattcccaagatgattgatttaacgaggtttgcacattagaagccttttccattgttacaataagaggaaatcacaagaaagattaatgccctctgcatggtgccactgtattaaaatgtctttgaaatgtcttcactccaggagcatttcctacccatgccagtacttagtaaagttggtctcagtgtaaaggatttattagttacagccaatgacgctgttgtgctggaaataaatacctgcaatatgcttactttccaagagacgtataaaccagtcagtttccaaacaaaatttaacttcatggcctagtacaaggagagcacgtctctgagatgcttgcaagtgaggccacccacaggtctgccacagtatctaggatcttgtcacaacactgcagtgttaccaaatgggaagcaaagccatgagccctcctatcacttggaaagcttctcacacttagatcctcactggcattttctctaaagtaatggaatgttttctcgctctcacctttcctcttcttcgcagacacaggagaaaaaatatttcaatctgctcttacaatctctaggatggtgccatacacctgagcctgttttctcatactgcttggattatataaaagaggtgacttcagagaataattttttaaatgattaagactaacactcctatacccatatacaaccaatagcattaactgtgtaccaattatatgttccgtattgagctaagtgctgggatatacacatgaaacaatttatgaacaaaaaattatgtattatttcattaccatgaagtaaaataataaagtctaaagtaagtagcatatacaacaataaaacaagttaaaataagaaatatcatatgaaatgcaacagaactgtgattgacagataccaaaatgtacatggcatagaaaggcaattgttggcatgcaacaaatcttaaatcaacaagcacagaaatagaaaggtttctatctagtatatctatattattccctggtattatgcatttctgtttctttgcctctcctcatgctcccctggtctggaatgtttcatctcttctctgttcatccaagtgataatgtccttaaggacccaactgaaatcccacttccccatggcaaccccaaaccccatcattctcccacttctataaacttttacagtttttctagtaaccatctcatacttcagtgtatattggcccatactgtttactattttttccccttaactaattatcctagctggcttgcaagcttcatgagagtaggaaacaagtcttctatgacttctgtttcctcgtaacaattattataggagtgagcacgtttttatttgcacttaataaatacttgacactttggtttgatgtaggatggcctgttaccaaaagacttcgtgaggttataaaaaagttgttaaatgcagaatggaaacattaatttattcaccacttcaaagtgaataaacaaaaatagtcatcaaaatatatagaaaacacagacactgaggtacaaattatgcagtggtaaatgtttaactcattcattagtttaaaacagtaaaaattagaattgggaaaaaatccataggtaaacacaataggaacaaacagtaatagatgatgattaatccataagcaaatacaatacgaacaaacattcatgtattaacttctagtttctttgccttgttccaaaaattctagcattgcttcctaggcatctctctcccttgcaatgaaaaagttaagattaactgtctgcagatcacgagggtgtgggacaagtagaaaaaagcaaagagcttgtacacacgaggcattcaggagccatgtacggagaaaattgaaagagaatgaaaagaaaagctgttcagggagctgctggtgagagaggtaggggtgaaaacaaagacctggattccagttatatttagctgctaactagcagaaggatttaggaaagttatttaaactctttgaattacagattacacacgtatctgtaaaatcagaataataaaacctaccatacaggattgttgggaggattaaattagttcctggctcattattgacactcagtaaatagagcaaatctcacatgttattatcaataataggccttgaaattttggcaatctcacctcagcctcccaagtaactgggactacaggcacacgccaccatgcctggctaattttttatattttttgtagagacggggtttcaccttgttgcccaggccaccctttccctttgtttggctacttctttgagcattcagtgtcttccaatccaacttctatcttcacactttcctcctcttgatattattttcatgccttcactttcatctattctatggcaagcacatattgcccctgagagtacagaaagaaaaaacgcaaagaagaaaaatatgaatttttgtgtgtgtgtttaataagttgaatcagctgggcgaggtggctcacacctgtaatcccagcactttgggaggccgaggtgggtggatcacctgaggtcgggagttccagaccagcctcgccaacatggtgaaaccctgcctctattcaacacaccaaaattagtctggcatggtggctcatgcctataatcccagctactcaggaggctgagacaggagaatcgcttgaacctgggaggtggaggttgcagagaggtcagtgagctgagatcgcaccactgcactccagcctgggtgacagagcaagaccctgtctcaaaaataataataataataagttgaattgtatgaaatggccattttgtagggaaaagtttatgtatatgatatatgtttataacagtatgtctatctacaaacattataaataccttctaatgttttattgttctgagcttatgaaaagtgaagatacatttactttagtaacattgcaaagccatgttcaacatgtggagaaatttcaaaagtgagccataaaactcatacaaaaggttatacagttaagtttcttcagttgaaagcaagagaagccaactctggccaatttaagcataaaaagtaatttattggaaggcataggatagttcataggattttcttttcttttttgagacggagtcttgctctgtcatccaggctgaagtgcagtggcacgatcttggctcactgcaagctccgcctcccgggttcacgccattctcctgcctcagcctcccgagtagctgggactacaggcgcccgccaccaagcccggctaatttttttgtatttttagtaaagacagggtttcaccatgttagccaggatggtcttgatctcctgacctcatcatccgcccgcctcggcctcccaaagtgctgggattacaggcgtgagccaccacacacggccaggatagttcataggattttttaaaaatctgaacaatcaattcttgggaaacattgaagtagggcaaccatagacctcaagagcaagaattaatgttcagaaaccttaggaaggtccccagaaatgatgaagttctatttttttcatgggttttcctttcatgattcaaagttcaggtagagtctagctggcctactttaggccaaggctccacacagaatccccatgttgtacaactctaggggccaaattcctatttagtctgtgactgaaccagtgtgaaagatgttccttggaattacatgacacgggatctggcgttaaagcatgtggactgactgttccaacagggcagacaaaattttacttttttgccccccagaagtaaaattttacttcccaaagctggaggaaggaagaagagaggtctaccagagcatgtgtctgtgtccagtgacaaagggcaagcaaaagatactcttctgagatgagtaacctggaaaaaaaatcacacttattttcacaagttacactttaattgtttctgttactgaaccctgtaagagaacattctcatagctgcttatgagacgatttttacaattgtttagctaaagtattataagaatatgagtcttcaaagcacagggcttcttattgcttatgggtgtgaagaggaggggttcttcttagctggaaataagtcagatgcttctatagaaaaaaaaaaataagcccataaccctagccaggaaggatgaggatattcatgcatcaattatcatagttctgccagtcagatatacaggaagtatacactgcagacctgaaaccagatcaggaaaagcacatcctaaacagatggcgttcagccaagcaaagtgtcttttattaagattccacacctccaggtgcacatataagtttcatgctaccacaagacaatgtcgagacttggcttcctgagtgacctggttgccagtttctaccccatattttgtgggtacagctaaaatatcacaagtggtttaagctcagattacaatcttggctccaccatttactttctagttttatgagaccctgggcaagtaatttattctctatgtctctcagttttcttatctggaaaaaatgggaataatattcctgtcccacagggttgcatattattacataagttagtgcatgtacagtgttttgaatgtgccttgggacttcataaatactcaataaaaattagctagatatttttctcctaactctcctcgtatgcaactattattgattccataattatggttatacaatcacctttcacccttttagtttgtatacatgtatgtccgtttctctggaccataaccttagctttcctccaaactatattctatggtttcatctatcagaaaaccaacatagagcacttcttttggttcgacccagttttcttcttggtcacccattgccctcacagtcagttcttagtctgatcttttatgacttcagatatgtgagcaaaccaatgaggaatctgaccctaggtattcaagacataactctcatattgtgtagaaaagaaaatcaaagcaattagcaaggcattaagttggtagtgaagccaccagccctttgaggctagaatatagctaacttgggacaaaattccataatctgggaatttgactcatctatgctaaaaattttctttctagtgtccctctatgcttaaaggtcacaaagaaatttcaaatactaacaaggtgtcttgggtagcaagagctcagtggcatacagcactcaaatttgtcccaaggaaggagccaggccaggagctcatagagcaatagcaagccattgaagcagaagcaagtaacacatgttggtagctgtaccattaagagttgcaatggatttggctaagatgtaaaaataaagcctcaaaaaaatgaaagaggttgggcgcagtgcctcacgcctgtaatcccaacactttgggaggctgaggtaggtggatcacctgaggtcaggagttcgagaccagcccagccaatatagtgaaactctatctccactaaaaatacaaaaattagtcaggcatggtggcaggcgcctgtaatcccagctactcgggaggctgaggcaggagaattgcttgaacccaggagctggaggtagcagtgagccaagatggcgccactgcactccagactgggcaacagagggagattccatctcaaaaaataataataatgataaaataaataaaaataaacagaaagaaaaaaacagtactcagcatgcaggtaaaaggtaaggtttatttgaatgaattcagttaatttggtaatgatcaaaagacaaggagataacagtaacatctggataaaataatgttctaccatgcattttcattgtctactcagtagcaatttctctgtctcttaattactaaagcactcaaattcattcaaatctaagttggccatgttctttccaaaagacaccttctacccaaccccaagaagttaggtttgtttggtccaagccaattatggtaattccattttccttattttaggaatgggcatgtaataaaagactcacctgtaagaagtaaggggagacctctgtggatggatagatgagcaaggtttgtcattttttaaaaaggcaagaagaaaatggtaagagaaagaatcaagcatttattctttttcctgtattttgagtaaccaaatagtttttgagagttattctttattcaagaacaccaactaaaaaaatgcaacccttaaaagaacagtgaatctaggcaacaaccatcaatagatgtcaaaatattatgcaaaagttgatgtggaactttatagtggatggaattttatagtggatggatcttattgacaacttctgaatccacagatgaattttagtatactaaaagtagaacaacaaggctgtatctgtcctccaatttgaagtttggggctgtataaagtatcacttgtaaaatattcttacaaaacaaaagtgaatcttaatctattcaagtctctatatttaaatctctagtttggaaatatgaggagagataattaggttaaaatcatcgcaaggaagcaaccagccaaatccagaacacaggataaactacaggacaaactagtttcttcaagaatatgaggagagaaggactcttgtagattaaaagatgtttagagaagcataacaaccaaatgcagtgtatgaaccttatttggatttttttctttagaaaaaaaattgaacacagattagtgtgtaaataagtttaagaaattattattttcattacatgtgataacagcatcacatttaaattaaaagtccttaggtgcttaaaatgcatgctgaaatatttgtagataaaatatataatacttactttaagataatcatgtttaaaagtgtagaaaaggaataaatgaaacagattggcaaatatctgtaattgttgaagctgggtgaagggtgtatgattgaaattttctgaaattgagattttagacatatgggaaaactgtaacatgagaaatgatgcactctcttcccatttccaacttctgaatattattgtaaccatgaggggacaactcttcttatggcagagcacagaaagagaaaaaaaaaacagaccttgatgacatcatgagctagtggattatccagcccttaaatcattttactctgtgattttactatgtcaagtaaaaaatgctttattatttcatctaattttaaaatgagttttctgttacttgcagccacaattatcttaattgataaaatgttatatataaagttattttgttgctgtttttaaattatttatttttaattaaccaagtaattacacgttcattgaagcaagttattatacgctcattgaaaaaaaaacaaaaaagaatatagaacacagattattattccccttcatgtggcccatctccctctccttaacagaggcaaccacccttaacatattttgatttaaatgttattggaatatctgcatctatgtttgcctagatgacattgtttatgaggactgctttgtgagtctgtgtgcctatgtatctatgtgtatcatcatttgtgggacctgatccttctgggacagacaaggaatctgtcttttcattcacttctaattatctccccccagtggctaatgtagcactaaaatttcaccatgcactgagtaaacccttatttgtagataatattaatggtgataagaatagccaggcttacaagaatcatttccaaactgcactcaaactgaactccaagtctgcaaaagcaatattgtaccttccccacccccacagaaaaataacaatagatcacaaccaaagataccagcaggtgtgcaacatgcaaatggcaagcatgaaaactgaagtgactgacattctgaagacattttccagcaagataaattgtcaaagctgagaacatttgaacagcagggcacagcaaagaggcattacatcttcacatttcaagtcatttggctgtgcacggcagagttacttataaaacttagtaaagagaaatctacattaactgttgagccatccataggactgcatttggtagggagagagggcatatgtgcccatctgttccggatctagctaccttcccaaccttccctctcttgtcatttttagaatgtaaacattctgaatgtagggaggaactgggttctgtggtatgttctgaacagtttccagcactttgagcacttagaacatttttaaggaataacaacattttgcattggactgaagggaatagaacttccccttcatttgctaaaatgagaatatcttttattcaccaaaagctgttctttggctgaccaatttagcaaaagaataaagaactccttttctcatgcttagaagggacctgttcttaaacaatgaaatggtaattcaaggagacatgtagcagcagagagccagtttgtaaaagtacttttctggacaagtaagatactttcaaaacgtagaaactcaattggacccagctagattttgctttgggaggcccacagtgcctaatgcagatacaggaaaaaaaaaaaaagtgtcagattagggcaggcatttagaaaaagaacaaaaaactttttgattccacatgcctaagtttaaaaaagggaaaagggaatggtgtctatcttttagaatctttaagaagtaatagtaacctgattctttaaaagaaaatcaaagcttttaaaattctaaatttttttttaattttgatttttttaaaaaatcaaagcttttaaaatcctaaaaattcctatggaattttttctatagatatcatcattcaagtgtggaacaaatgtaaaaataaagtgacttattgtgcactgaattaatgaaaaactggaaacaatacaaatattcatcaacagaagaccagttgtcataagcacatcaaaacatgaaatattatgtagctataaaaaaggatgaaaagcttctctacataatcatgaaaatatctgagtagtatattgttaagttttaaaaaatacaagagtatatataatataatgacagttttatagtaaagaaaaatatctatatagcaaatatatgcatgaaaaaagtctgtaagggcatattttaaaacctcatggtggctacgttgtgggattgggaactgagcaggtacaagataagaactgaaggactgatttttatggtgtagtgtttcatagtttttcattttgaatcatgtgactgttaaaaaatgtttttaattcagtcctttttaagcctttctcaaaatttacgatgaattaaacaggccaagtttcatcttttggatgatattttttaatgcctacttccatttattgcaaaaggaaagcaatcctgcctgcatttatggactcaaataaaaaaatagagcaggtaaaaaggaggtaagtgtataatacactatttttccctagacagctgaaaacctgaatatataaatatttgaaatggtgtgttgctaatgtaaaatgagagatgtaacctcaggggtagaactgaattcacaagggaatgactacaatttagaggaagaaaaatacatacagtcagactaatgctaaaaccccaactgtgtccacagagactgtaaacaagaagtctgggtgagtgacaaacatcataagatcttcaacaatgaatgatagtttgtatgctccactccatttatgtcaataatagttatattatggaatgtgtagatggcctcacccaaaggccctattactatagagaataaaagtgtggcataaagggcaactctgcccattgcccctggttaaaataaattgctgagaatacaatccagtccaagaatgaatgcctaaaggcctctgtttaaagttttaacctaatccctaaaaccttttgttgtatctgtatttttctatcatttctcaattgttttgaaaataagcacctatagtagtcggggacataaaagctatattaggttctctctcaagacaatatggacccttctttctcaatgataacacaaaacaacacaaaactaaaaaaattcaagtactattgttgccttcattttatccctcttgctaaaaaagaaaaaaattaaataaaatggccactgctttttaatgttgactaaatgaaaaataagccaatattacacacaaaaaacaatgaacataaatgataagctcccattatatttgctatttaatttgtagatgttaattataaaagtaaatcaatgtaatgtagacatattgtcttatagtgataaataattccacagtgtgattcacataaaaatccttcatttgaaaatgaagtcactttttcaaattagggaaaacacacttgggaagattggagtctctccaaataactggcagaagcataaacatgacttaataatctgagtgtcatttcaaccaagtgtttgtgaggtatcagatgcatgaaaaactctggtgaaaaacaagccagaagcatgttgcaacaaattattattataatatgattcatttctgtacatgatttttagtattaagtcagtgatccttcctaaaatccagactacagggtatcatagatatttattatttcatttgtctaacacatttagtttcataaccagatggctatcagtagttgcaactttaaaacattatgaaagagcctgtttaacaatttgagtgtgccaaacagtgacttcctctgcaaaaaaaaaaaaaaaaaaaatcaaatgcaaaagtaaaagtgcaatcactcatcttgattattttgcctgtcactaaatatctgaaagtagatatagaaacttaagaaatagagggctctaggaggcttttagtaatagaatttcttctacaacacttgacagatgatcattcaatctggattatcgttgagtgcccttagtcagtgataaggagttacagtaatagtcattccttgttgaatggatctaattgttatcagaatttttccctgtttcaacagttagcagccccatgctgtctaccgaatattccgaagccaaaaaaagaaaagtctatttttcccccaacatgataggttttcaaatattcaaacactccttccacgtacccaggtttttggttccaaaccaaagatttttcagttgttttcttataacatactttccagacgctataccttcccagtttctctttgacactctcatatgataatgtccctattaaagtgtataagcgtggctaacaccatgcttcaactaacacagcctaaaattgcacaccttaacagttacaacacattttttcaaatctcagagtggttttaggattaaccataatgctagggtcttttcagtatcacattttttgacattttatattactttaataatcataggactttacgttaatatctgaaaatgttaactaattgtttttagtacctctttccaaagagttttaattttcaatcagaattgaggcatacccattatacctaaagttaatattattgttaatttttataaccttggagcctatttccaaaaccataaaaaagaatgtttgagtaactaaagttagaaaatttcattagagaaagtctcagaaactaacattggtgcattaatcaaccaattttctttgcattttgttgtacagtcatatgcatttccagttatttgtgttatcaccaatttcacattttattacccgttcaaaaagtatgtgaagagggttgtcaaataaccaagacactctacaccatggaataatgctgacccaccaatttagcaattcataaagaaatggaaataacattagttagtaaggactttttgctggtgaatacatgctgccacccagagattacattccatatttcagtgcactttgtcccagtttatttcttcacccaagaaaaaggataacaattaattctctacaggtatgaccttggaatttggattttaactgttatgaaatgtaaaatttttaaaagcttaaacattaatgaaatttctaagaatagtcaaagcaagaaacagaaatctagtatggttactcagtcccagtggaatctggatgttttcttagtgacatgaggtttatctctgaggtagtaaatcataagatattctggagaagacaagcttcatttaaacacataccttattaatgttatccaaagttgcatgcgtatttgtttttaaatgccttctctttctgtcaatatttgctaactttctggcaaatacgaataggctagtagcaaagtattcttccttagttatgatactatgtatggtgaacaaataaatgaacaaatgaataagtaaaagatgaaagaagggaaggagagggagggaggagggagaaaattgtctattgaataaattcgtcttgtactgtctctgttggacataaatgcttttcttactggcttccagtaggaaaggaaattaactaaatggaagagcacaaaggtattatgaaagaggtacatcaatgatgtgagacaccactacccaagtttttacacaagttctgggatagacttgactaactttttccaaatagatttttaattttcaactgagagagataaactctttgaagtctagcccgtggactaacacagaaacataacaagccagttaagatacactggtcggccgggcatggtggctcacacctgtaatcccagcattttgggaggtcaaggcaggagaatcacttgagtccaagagttcaagaccagcctgggcaacatggtgaaactctgtctctacaaaaaaataccaaaattggccagctgcagtggcacacacctgttgtcccagctacttgggaggctgaggcaggaggatcacttcagcccaggaggcagaggtcacagtgagctgagaccacgccactgcactccagcctgggcaatagaccgagaccctgcctcaaaagaagacacagtggccggtggcctacttgtaacactttagaaagcctaatttaaattataaaaaattatttaaaatattcaattatttaaaaaatattatcttaataaaaaatgattctaacataaaagacttaaaatataaaacacactttaaaaaacaaaaaaattgagattaatcaatttctaaataaaaagaaattgagctaatataaccacataataaatcaattatggtataagtagactatgtagagattaactggtctataatgcttaccatgatattgtggaggtaaagataacaaaacaagtctttttgtcattaacgtttcttcaatttcaggttataggataatccaaaaggctttttaaatattctcaatttttcagaagtagtttattttgtaagatttctcatcatgtgtattcctttttttaatctttgccctcaacattaagaaagtcatttgattgtttttaatttgcagtattctgccagcagcaaatgtgaatgacaatattacttgcttttccttcctcctattaaagattgcaagcgttaaaaaatttgattcctatttttgttttgagtcacttttggcaaagttggtaagatgttgattgtgtaatggggaagggttttcttcatcttggcttaactctacccctgttatcgcaccatgacattttctttgtcctgggatggctaggagaaaaggtgtatgggtactttgagctacacggactctaagttctttggatatttgtaacaggaaaatctgtaaatttgtcattgcaaaactgtaagccactttacgccttttgagatgtgaaaatcacacaccacttcttcctttgtccttggaaaaatagcaaaatgagtcattttgttataaaatattaagtagtcatgtttgggaacctatggctccaaagagctaaaatgctcactgaaatcatgtagaaggctgagttcaacctctgcggactttctccttttaagaaatatccttttttagctttgcgttttcatggtagcatacttgctgactgttgctttccttatggacgaggatgtgtgataagtctaattattattgctcatgtaatactaggaactaagacttagaactacagaaaagatatctgatattatactggtttgaaggatataaaagcaaactggagtcagactctctgggaatggaggcttacatctatatttttagaaagctccacgcgtgcttctgaagcagagccaggtttgaaaatccttttactacagcgtattgtaggaaactccctcgtggtataatttaagattcaataaaccagactttgaaaataatctaatgttgggctattatgttctgatgtgattatttggggcaaggacacaccaggaatgttctaagactggagtttccctagaaagaagtggaagtgggaagccacagggacgagagaggcaggttgagacagcacatatgactggaatggtgaaaatttctctgcacacactgggccttgtatttcaagcacagcaacttggagcatcaagacatactgaaaggagctcctggctgtgcgaaaagctgaactacatttatggcagcaggccgggggccattattctttgtgcacaagaatgatgagtgctaagggaaagtggatagggcactgacagcttcacccacacttgggaagtaggctaaatgtgcatgaagtgtgcacaaagttatcgagttatccttctatttctcatttgcgtgtgtgtgtgtgtgtgagttcactaaatttagttctgaactgcagtgcaaagaacattccatttaagatactacaagatccacctgctcaaagtttaattttccctcagcaaaaacaaatgaagcagaaagggtgtatctggcaccttttggcattcaacactttctccattagcagctcaagatgaaacctaaatgtttgcatgtgctctaggccctagtggaggcaaagatgttgaaacaacaatggctactgctgttttcagcttcacgttagtgtacaggattcacaaaacttaatttgtgtgccatataatgacaaatctcatgactgaatatgctgacacagtgaactttctctcacagctacaaaaagattctaatgatttgtacagatttatctataagactctaattgttgggtaagaatgaaaacttgcctgttatgttattgcatattgcgtatttcctccataaaattctaccattttacactcccatagcagtgtgaaacattctcatagacttatcaacattatatattatcaaatttggggtttttacaaacctgatagatgaaaaatgacaccttggtgtgattttaacttgcctttcacttgctgtgagtgaggttgagcatcttctcatgtgtatttgagaccacatgtatttctgtttctgggttgtgtctgttcatgccctttgcttattttttgggaggaaactacttgacttcttctcaattttcacgatttgtacactccttctattaaagttctccagagcaaccaaatcccccttatatatgtgtgtgtgtatatatataatgtatggaatatctatatcatatatagggaatatctatatctttacttatctatctatcctacatatataaattccctatatatatataaattcctatatatataaattccgcatatatatgtaggctagatagatgatagatagatagatagatagagaatttatatatgtaggatatatagatagataaagatatagatataataaaattattatgagaatcggctcatgagattatggaggccaagaaggcccacaatctgctgtatgcaagctagataacaaggagaaggccagtgatgtaattcaattcaagtctaaaggcctgagaactggggaagctgtggaagtcccagtggaaggctgaaggcctgagaactggggtagtcacttgtataagtcctggagtctgaagtctagaaaaccaggagctttgatattccagggcagaagatggatatccctgctcaagaagagagcatgcaccctccttctgcctttttgttctattgaggctctcagtggattggatgatgtccatccacactggtgaggggacatcttctgtgatcagtctacgaattcaaatactaatctcttttggtaacatcataacagacacacccagaaataatgttttatcagctatctgggcatcccttagcccagtcaagttgacacataaaattaaccatcacaggccagatacagtggcttgcacctctaatctcagcaactttggaggctaaggcaagaggatcgcttgagcccaggagttgaaggctgcagtgagtgatgattatgccacttcactcctgcctgggcaacagagcaagaatctgtctctaaaaaaacaaacaggccgggtgcagtggctcacgcctgtaatcccagcactttgggaggctgaggcaggcagatcaagaggtcaggagatcgagaccatactggctaatacgtgaaaccccgtctctactaaaaatacaaaaaattagccaggcgtagtggcgggcgcctgtagtcccagctactcgggaggctgaggcaggagaatggtgtgaacctgggaggcggagcttgcagtgagccactgcactccagcctgggcgacagcgtgagactccatctgaaaaaaaaaaaaaaaaaaaaccaaaaatcttaattattatactgcccctaaattggtttataaatttcatgcaatttgaataaaaatgccaacagggtttttttttttttttttctgaaacaagacaaaaagtgctggggttttggacacttcttgcttgtttatttttctttagtaacaagaaacaacttgaatttactttaaatatacagaaaagcttataagcttttcctatttcttaagtttcacctaggtactgtatttaatcttttttttctattgtgaaaagggtcttgtcttcaatgatatcttccaacttattgactttgtgtctattaggtatttatttctgtatgttaatttcaaatcctgtgacctttctgagctttgtaatagtttttaatagattctcttgggattttttagttatttattcataggttgccttttcattttctgtttttataattttaatttttttctcttatctaattgtgctatctaacattgccagtataattttaaatagtaatgctgaaaatgagtgttactgtcttattcctgacttgattgagaattccttcagtgcttattgattttgtagtatgctgttttggagataatgagacacaaatatgcacatatctgtgtacatgtgtaagtatttgtatatatgctatatatatgtttctacacacacacatatatagttaatctatcagttttcatttataattttaataaattaaaaatggagattgaattatgtcaaatgtcttttcagcatccgtagacataattatataattttactcttaaatctattaatttactaatataaaacaattcttcctttgctggaataaacccccatttggttatgatgtgttattttttaataaactgtagaatattgtttgcttatattttatttaatataattgcataaatatttagaagtgagatcaatctgtagtttttatctcatggagctttaatagttttggtattaggccaggaacggtggctcagcctgtaatcctagcattgggaggctgaagctggcggatcacctgaggtcaggagttcgagaccagcctggccaacatggcgagatcctgtatctattaaatgagtacaaaaattagccaggcgtggtggcaggcgtctgtaatcccagctactcaggaggctgaggcaggtgaatcacttgaacccaagaggcggaggttgcagtgagccgagatcgcgccgctgcactccagcctgggcaacaagagtgaaactcgtctcaaaacaaacaacaacaaaatttgttttggtatcagtgttatactcacttcataaaataaatctgtaccttgtcctgtgttttctttaactggaacagcttaaaaagcactgagaatacctgccttttaatgattttatagaaatattatctagaaaacatctggccatggtgatattttaaaggatggcactttgatccatttttctatttattctaacctctccttcccttcctacacctcatgttctccattatccaattttaatcaataattattttcacagtgtttatttttggaatcttacatatgcttacacttatgctacttgatttgttacctattttacttccacttattacttatgagacaactattaagttcagtctacttttttcttttttttttttttagatggagttgctatgttgctcaggctggagtgcgatggcaatggtgcgatctcagctcactgattgcaacctccgcctcctgggttcaagcaattctcctgcctcagcctcccgagtagtttggattacaggcacccaccaccatccctggctaatttttgtatttttagtagagacagggtttcaccatgtggtcaggctggtcttgaactcctgacctcctgtgatccacccacctcatcttcccaaagtgctgggattacaagcatgagccaccgcgcccagtcaagttcattctactttctaccatctctccttctcctttcatttttttctcaagtcctcagtttttacactgtcaaggcatctaacaattatacacaattatgtcacttttatccttttgtcttattacttttgtcttactactgataacatatttaagtctatctgttgcttattattggttcttttgccgtttctttccttaatcatcttttggttggaaaaagtgcaacttcaagatcttccatgttgtacatagattatctgaaacctgtacacataaaggagtgtctggctgggtatctaatgcttggctcagacttcttttcttgagtacagggctctacaatgttccgtaggcattaaatactgctttcgaaaagtatgatgcagcttagtttttgttcctcataacttggagttcttgtggagttatccagagaattttttttattctctaaagtccaatacttttatttgtttatatcttaatattgattctggattggttttcttaggtatatgatatgccttttcaagagattcaaatcttatgtgattttagggatgttcctttgaattgtagtttaaaatatttgttctgtaactttattttgtttttcttccttaagaacttaaattatatgtttctggatctcctttgtccatttttccgtctcttatttttttattttttacttttttcccattttctttctcatgtcattattgtgtttttatatctggtgtcacttgtgccttttgtaatttaatctgcatttctgaaataattttatcttttcctttcatttctttcctgaattctgtcaattcacagtttcatgtttctactctctggccatctcttcttttgagttcctttatttctagtccatgatttttataactgtgaatatatatatatatatatatatatatatatatatatatatatatatagctttcctttataatataaaaatgtttgtgattttcttctaatcttagcagtgtttttctggggagttttctcctgttgctgagctctgatttttctcatgattttacaacatcttcatttgaattcagcatttttactttttcgttcatagctgaatgagtttttcctggctcacctattatcaaaagaacctggtaaaggggagaaaagaggtaagggttgtgttttagttcacttgtgctactattatagaatacttgaaacttggaaattcgtaaagaataaaaatttcttcctcagttttgacacttccaagtccacaatcaaggtgctaaaaggtttggttgtctggcgagggctacttcctgcttccagaatggtgcctcaatgctgcatcctccaaagagaaggaaggatgtgttttcacatggcagaaaacagaaggttaaaaggggacaaactctctccatcaagcccttttaaaagggcacctaatcccattcatgaggataaaatcctcatgattcactcaccttgcaaaggccacacttcccaatactgttgcattggggattaagtttcacacaaattttcaagaggacaaaaatattcaaaccataacaggttgctttctcagtttcttagctcaagaaatctgccttagatagctgagctgtttttactcaaacatttctgacaccaaatgtgtggggatttttttctcacaccaaacaattctctcactctctggacaccaactaggtgtcctataattcaatttaattgtgacactaccacgagttagcacagaccacgcaggtgaagggctcagtcccataagactaccctcacttcagatgccagtcacaagttctggtttgccacctgtacatatgaccaaataactataaattcagggtatccatgacccctccctcaggttcaatagcttgctagaatggctcacagaactcagaaaaacactttacaagtttattataaaggataaggctcagaaacagccaattggaaaggatgcataggacaaagtatgcatgggttggggagtccatagactttccttgccctctctggattatccattatcccagcacttcagtgtgttcgctaacccagaagctctccaaaccctgtcactggggaaggggggtggttatggtgatttcattatgtagccatattgatcaaatcattggccattgatacttagctcaacctccatcttctctctcctccccagaggtcaggagttgaggctgaaagttctgaccctctaatcatgccttggtctttctggttactaccctccataatgatatctaggggtccccagctaccaatcatctcattagcaaacaaagacactcttatcacttttgggattacagaggttttaggagctaggtgctaagaactaggacaaagacgaaatatatatctcctactgtattgctctgtaaccagtattttctttaatatcatctctcactaccaccctattctctacactgtctacaattgttcacattgcttctctgagcactaatgctctcccctccttgttcttggttctacccacagcagttcttacagagggccccttcctttggtggggtgaaaatttgctggcattgtttgtgctctgcctctgctagaaaatctcactcccagttctttcctacaacacctgccatcatccaacactgtttgtcaaccccctgctattcttcttgtttcaaatgttcttcccctaacttatattttattcagtttgtggatttttcttggtcttctagtttttttgaaggctgtggagagttgtatcgttgttcttgttgtctctattataattcagaattcctctagttctaatttcaagttattatttctgttttcttatcttgtattatccaggagacttcagaatagtttcataaaactaagggctagatctctggtagattgtagaaaactaagggaagcatctatgcccatgcatgggatcaaatagaaagtatggaagaacccttagcaggctgagggaggtcagccatctgagaccagagaaagcattatgagtggaaggagactagactcagaaagtttatctgcagtgtggaaacagacagctgaaaacaatacaagatgtgttatttataaaactagtaggcacactcaggcagtcacatgaattctggtggaaaagaataataacagcaacggcagctaacacagagcacctctatgtgccacgcactggcgtaagtgctttacatacatcaattcatttgtctctcacaacaacactatatgatagttacagttcttatccctattttacagataagaaaactgaggcatacagcatatgagtaatttgctaaaggtgaatagcaagtgaacaatagagctggaattcaaatccaaacaatctgctccagattccatgctcttaactagtaagttatttgtattcatcaaactttttgaaagagataagtcatcttcagaaaagctgacttttaaggtgttctcagtataagactctatgttctttagtctctttgaatgcatgctcaaagccaccataatttgagcaacagtgttaatctgacctcatgtgtgccataagccaataggtcagggaaattctgctttgcacatatatattaagaataagtactgctttggtactttagaaatcaatgggtgaaaaattctaatctggaatatagttatttgagtaagaaaatatatggtttacttcaagatggcaaagatttcatgtgatccacattttaaatagaaaacctaatattttaattttaaaatcaaattaatataaaaaataaagtgtctacaaactaaaagtcatacctgtcctgcttataaaaatggcaacttttatttgtgttctacatatggtataaaatcttgcttccttgaaaatggccccatattgaaaaatgagattttttttttttttttttttgagatggagtctcactctgttgcccaggctggagtgcagtggcgcgatctcggctcactgcaaactccacctcccaggatcaagggattcttctgcctcagcctcccaagtagctgggactacaggcgtgcactaccacacctggctaatttttgtaattttagtagagacggggtttcaccgtattggcagggtggtctcgaactcctgacctcgtgttccgcccacctcggcctcccaaagagttgggattagaggtgtgagccaccacgcccagccaaaaaaatgagaatttttaaaacaaccaccagtatgtaacaactaccactgaataattagtgtcacaatcactggagatacagacattgcacagagaacttaggttcctttttcttaattttttaaaaacttttattgtaggttcagggatacaagcgtaggtttgttatataggtaaattgcatgtcctgggggtttggtgtatagattatttcattacccaggtaataagcatagtacccgataggtagttttttgatcctttgcctccttccaccctctgccctcaaaggagcccagtgtttgttgttcccttctttgtgtccatgtgtactcaatgtttagctcctacctatatgtgagaatatgcagtatttggttttctgttcctgcattagtttacttaggaaaatggcctccagcttcatccatgttgctgtaaaggacatgaacttattattttttatggctgcatagtattccatggtgtgtttgtaccacattttccttattcaatccaccattgacaggtatttaggttgattctatgtctttgctattgtgaatagcactgtgatgaacatacacatgcatgagtccttatggtagaaatatatatatttgttatatacccaataatgagattgctgggttgaatggtacttccattttaaattctttgaagaatcacaacactgctttccacaatggcagaactaatttacacccccaccagcagtgtataaatatttccttttctacccaacctcactagcatctattattttttgaccttttagtaatacccattctgactggtatgagatggtgtctcattatggttttgatttcatttctctgatgatcagtggtgttgagcttttttccatatgtcttcttttgagaagtgtctgttcacgttctttgcccagtttttaatggggttgtttgtattttgcttgttaatttaagttccttatagattctagatattagaccttttgtcagatgcattgtttgcaataattttctccaattctgtaggttgtctgtttactttgttgatagtttctattgctgtgcagaagctctttagtttaattaggtcatacttgccaatttttgtttttgttcctattacttttggcatcttaatcatgaaatatttgccagggcctctgtccagaatggcattccctaagttatcttccagggcttttacagttttagattttacatttaagtctttaatccatcttgaatttgtttttgtatgtgatgtgaggaaggggtcctgcttcagtcttctaaatatagctagccagttatctcatctacatttattgaatggtaagtcttttacctttggcttgtttttgttggctttaagatcagatgtttgtagatgtgcagctattttcactctgttctattccattggtctatatgtctgtttttgcagtaccattctgttttggttactgtagccttgtagtatagtttgaagtcaggtaatgtgatatttccagctttgtttcttgctttgttttgtttttgttgttgttgttgttgttgtttttgcttaggcttgccttagctgtttgagctcttgtttttcattccataagaattttaaaataatttttttaattctgcaagaaataccattggtagtttcatacgaatggcattcaatctgtaaatttctttgggcactatggccattttagcactattgattcttcctatccctgctcatggaatgttgttccatttgtttgttatctctgatttctttgagcagtgttttgtaattcttattgtagagatctttcacttccctggttagctgtgtgcctaggtttttattctttttctggctattgtgaatgggattgcattcttgatttggatctcagcttgggcattgttggtgtacagacatgctagtgattttcatacattgattttgtattgtttaactttgttgaagttgtttatcagatctaggagcttttgggcagagactacaggattttctaggtatggaaccatattgtctgcaaatggaaataatttgacatcttcgcttcctatttgaatgacttttctttctttcacttgcctgattgctctggctaggactgctaatactatgtttaatcaaactggtaagagtgggcatcattgtcttagtctggttttcaaggggaatgcttccagcttttgcccattcagtatgatgttggctatgggtttctcatagacaactcattattttgaggtctgttcgttcagtgcttattttgttaagggtttttaacatgaaggggtgttgaattttatcaaagtattttttgcatttattgagatgatcatgtggtttctgatttcagttctgtttatgtggagaatcacattttttgatttgcatatgttgaaccaaccttgcatcccaaggaccaagcctactagattgtagtgaattaactttttgatgtgctgctggatttggtttgctagtattttgctgataatttttgcatctatgttcatcaaggatatttttacatctatgttcattaaggatattggtttgaagtgttctttctttgttgtgtctctgccagattttggtatcagaatgatcctggcctcatagagtgagttagggagcagtctctccttcttaattttttggaatagtttcaacaagaattgtaccgctcttctttgtacatctggcagaattcagctgtgaatctatctggtccttggctttttttgattggtaggctatttattactgattcaatttcagagctcattattagtctgttcaaggatttgattttttttctactcaatattgagaagtcatatgtttccagaaattaattcattttttctagattttctagcttgtgcacatagaggtattcatagtagtctctgaggtttttttgtatttctgtgggatctctggtaatgtcctttttgtcatttctgattgtgtttatttggatcttcttttctcaaaattagtctagctggtggtctattttatttattctttcaaagaatctactcctggatttgatgatcttttgcatggcttttgatttctcagttcccttcagttcagctttgattgtgattatttcttgtcttctgctagccttgaggttggtttgcccttgtttctttagttcttctacgtgtaatgttaggttattaatttgagatctatctgactttttgatgtgggcatttggcactataaacttccctctaaacactgctttagctgtatcccagagttcttgtatgttgtatcttcgttctcattagttttgaagaatttcttgatttctgcctaatttcattgataacaaagtaaactcattgtttactcatgtaagagcaggttgtttaattttcatgtaattgtatagttttgagtgatttaattaatattgattgctatttgtattgccctgtggtcagggagtttggttgatatgatttcagtttttttgtttttttaatttgctgaggattgttttgtgtccaattttgtggttgattttagaatatgtgccatatggtgatgagaagaatgtatattctgttgtttgggggatggaaagtaatgtagatatctattagtacaagtgttgagttcaggtcttgaatatcttctgcctcaattttctgcctcgatgatctgtctaatactgtcagtggcatgtttaagtctcccactattatgtggaaatttaagtctcttcataggtcctaagaatttgctttataaatctgggtgttcctaagtagggtgcatatatatttaggatagttcgtttttttgttgaattacaccttttaccattatggaatgcccttcttgtctttttttaatctttgttgatttaaagtctgttttatttgaaattagaatagcaacccctgcttttttctgtttcccctttgctttctagtttttttctccatccctttactttgagcctataaaggtcattgtatgtgagatgggtcttgtagagacagcataccattggttcttgctttttatccagcttgccactctgtgccttttaatgggagcatttagcccgattgcattcaaagtaaatattgatatgtgtggatttgatcctgtcattgggttgttagctagttatcatggagacttgtttatgtggttgctttacagtgtcaatggtctgtttacttaaggtgttttcttttttgttttttgtttttgtttttgtttttgtttttttaggggctggtaacagtctttcctttccatatttaccactcctttcaggacttcttgtaagcgaggtatgatgatgtaatgaattccctcagcatttgtttgtctgaaaaggaccttatatttccttcacttatgaatcttagtttgactgcacatgaaattcttggttgaatattccttttgttaggaatgctgaatataggcccccattatcttctggcttgttgggtttctgctgaaagatctgctgttagcctgatggggttccctttgtaggtgacctgttccttctatctagctgcctttaacaattttttctttcatttgactttggggaatctgataattatgtgtcttggggatggcattttgtgtagtatcttgcaggggttctcagcatttcctgaatttgaatgttggcctctctagtgaggctgggaaagtcttcatgatgatatcctgaaatatgttttccaagtggctttctctctacccatctcttccagggataccaatgatttgttgatttggtctcctttcaaaattgcataattctcagaagttttgttcattcttttttattcttttctctttatttttctctggctgagttagttcagagaaccagtctccaagctccaaaattctttccttaccttggtctattctgctgttaatagttgcaactgcattataaaattcttgtagtatccttgtcaactctgtcagatcaatttggtcctttcttataatggccaattcatctatcagctcctgatttattttattgtaatccttggattccttgaattgggtttcaactttctcgtgaatctcaataatcttcattcctatccatattctgaattctatttctgtcatttctgccatttcagcctggttaagaacccttgctgaggaactagtacagtcatttggaggaaagaaaacactctgtctttttgagttgccagagttcttgtgctggttctttctcatctgtgtaagctgatgttccttcactgtagtataatttgagtacagtcagctgacttcttttctggatgttttcagagggctgaggctttgtgcaagatctttatttgtagctgagttcttgtccttggtgtcacaggggatgtatattagcaaagtatttttggtgttgatgtttgggccatgatccagcagatggtgtttaagcataatggccagtaggtagactcttgctcagccacgtgactcctctgtatttcttctcaattgcaaccatgttccctcttagtgctctgaaagtgtgggctcctctcccactggagtgctggctgtgggtctcaggttggcactcccgggctgcacaccacagccatggtgcaaactcaggctttatgttccctccccatcttggagcagcaaggaatgtgaccttgacagtcactgtggctgagggcctttcacttgtcttttgagattcaccccagagaaatgcagagctccagccagtcagtgcatttggcccagggtggggcagctgtattgcaggccccagtcaggtggccctgcctggtaatgagcaaggatggcaaggggcttatcagggagacaaactgacctcttatcctttgggtggtcatggcttgccgaaagtgtggctaaagtactagggtctttgctcctttcccagtccaagggtagtaccactgcagtggcaatggcagaggggctttcagttgcttctgggagctccacctcagagaaacacagagctgctgctactgaggatgttcagccagataatgggtttgctgccctgctggctcaagctgtgggtccctcttggtgaagagtgggtaggtaaggactcacagggaggagagacagggctcctctatgtatggcaactgtgctgtgctggcaatgagagtaaaggcctcagtctctttgtttcttctccaatccttaggcaacaggggcagaaccactgccatggcagtggaagaggagtttttggttgcctcgcagagcccctccccagggaaacacagaaccactaacagtgggaatggtcagccagggttggggtggctactctgcagtcctaagctgggggtcctgcttggtgaagagtcagggatggaggcttacagggaagagacactgggctcctctccatgtaatggatgtggtgtgctggaggttccagcatagtgacaaggctctctgttccttcgccagccccagagcagtaataaaagtactacagctacaattgcaaaggggttgtgggatgcctctgtgatttcctcctcagagaaatgcagagcggtcattgactgaagtgttcagcagggagtagggtgattgtgttgaggtcccaggtggagagggactgcctagtgaagagtagcagaggtggggacccatatggaaaacagtctggccactttttcataaagcaccttcactgtgatgggggttcgcatttgtccgcaactgcgatgctaccttccaagcatagaggagcaacagctgtgggcagcaaaaatagcagcctccctgcttcttctgggagctccatcccagggaagtgcagagctcaagagctcaggcagggggtgggtggagtccttcctctatcaggtccccttatccagagagcagtagtagaagtgatgacccacgtgaaaaacagtctggccacttttctgaaaggcagctgcaccgtgcttggagtccgagatagttcctagtcactgcgcatcctcctgagcctgagagcaattggagtgatggctgcagagcagcagaaatgacagcctgcctctccctctgggagctccaccccggggaactgcagagctgcagtgcccaagaatgaaggcagagctgcaatggcctcgctagcagcccaggccagtaggcctttccctgtaattcttcttttagagatctttcacctccttggttaaatacggtttattttttgtgtgtggctattgtaaatgagattgcttcttgacttggttctcagctagattgttattcgtgaacagaaacattactgatttctgtatgaaaattttgttttctggaactttactaaattcatttttaaaatctaagggttgttagtgaagtcttcagggttttctagatataagatcatattatcagcaaatagggataatttgacttcttttccaatttggatgccttttatttttatttcttttgcctgattgctctggtaaggactttcagtactataagagtggtaaaactgggcattcttgtcatgttccagttcttagatggaatgctttcaacttttccccattaagtatgatgttggctgtgggattttcatagatggcctttattatgttgaagtaggttgcttctatgcctagtttattgaggagttttatcatgaaagttgctgaatttcactgaaggttctttctacatctaacgagatgatcatagggtttttgtacttaattctgtttatgtaatagtaatatatcacgtttattgacttgcatatattgaaccatccttacatccctgggataaatcccaactgatcatggtttattatctttttgctgtgttgttggatttgatttgctagtattttgttgaggatttttgcatctgtgttcatcaggttattggtctgtagtgctcttttgttgttgtgtctttgtctggtttcggtatcataatgatatgggcctcatggaatgagttaagaattctcacctctttgatgtttggaatagtttcaggaagattggtattagttctttatatgtttcttctttgtatccacaattcagctatgaatccatctggtcatgggcttttttttcttggaagttttttttgttactgatttaaaattattactcattattggcccattctggagtcctatttcttcctagttcaatctcaggaaattgtgtgttcccagaaatttagtcacttcctctaagttttctagtttgtgaaagaatagttgttcaaaacagtctctgatgatcttttgtatttctgtgttatcagttataatgtctccgttttcatctctgattatgtttatttagatcttctctcttcttggttagtctagctagtagtggcatatcaattttgcttaggtttttgaagaaccaacttttcattttattgatgctttgtgatttgtggggggagtctatatttcatttacttctactctgatccttatttcttttcttctgataaatttgggtttagtttgttctcttttccctgttccttaaggtgcaatgttagttaattcatgatcattttacttttttgatgtaggcatttaatgctataaatttccctcttacagcttttgctgtattccacagcttttgtggagtattatgttttcatttttattcacttcaaaaaatttttcaatttccatcttaatgtcttcattgacctagcaattattctggggcatgttatttaatttccttatatttgtatagtttcagaagttcctcttagtatttatttctagctttattccactgtggtatgagaagttacttgatataatttagatttttttatgtctgttgagacttgtattgtggcctaatatatgctctatcttggagaatgttccatgtgctgctgaaaataatgtatattctatagttgggcagaatgttctgtaaatgtctgtcaagtttatttgttctatctcatgaggcaaattggatttttttaaaaattttattctaaagtccaatttaaaaccaatgttcctttgttaattttccgtctcagtgatctgtctagtgttgtgagcgaggtgcgttaaagtcccctactgttgttgtattgctatctatctctttctttagatctagtaatatttgtttggtaaatttgggtcctctgatgttgagtacatatatatttattattatataatgaacttctttgtctttttatactttattttaaatctgttttatttgatatagatatagctattcttgcttgcttttggtttctatttgtgtggaatctctttttccacctctttactttcagtatatatgtatttatgggtaaggtgaatttcttgtaggcatcatatagttaaatgatgtttcttgatccattctgccaatctgtctcttaagtgcagtatttaatccacttatattcaagggtaatattaatatgtgaaacttttttcctgccttactgttgactgttttcaagttgttttataaattctttctttctttttctctttttgcctttgtgttttgatgaaattttgtcatgttgctgtttgattcctttctctttctcctttgtgtgatgggtttatacaaactgtgagttttatatgtccatgtgttttcatggtggtgaatactaaacttttgttttcatgtttaagatcatttagagtatttcttatagtcccagtctagcagtgacaatttccctcagcatttgctcatctcagaaagactttgtttctcctttatttatgaaatttcttctggcaggatacaaaattcttggttgatacattgtttttctcagcacttgaaaaatgccattttcttctggcctctaagatttctgctgaaaagtccacagttagtctggtggggtttcccttataggtaactaggcacttttctcctactgattttagaattctttctttcactttgactttagacattctgaatatatgttgtggtggggtcttttttcaatgtctttccttggggatcactgggcctcctgaatctgaatgtctctcttgatagacttgggaagttttcatcgattgtttctttaaatatgttttctaatcactctttcccttgagaacaccactaattcataagtttgggtgctttatatagtctcagatgtctcaaaggctttgttcattcttctaatcctttttatattatttttgtctgactggattatttcaaaagtcctgtcttcaaggtctgagattctttcctctgcttggtctagtccattattgtagctttagaatgtatttttttatttccttgagtgaattttttagtttcagagtttccacttgtttgggttttttctttttttttaagatcttcatctccttggtaaatttctcattcatgtcctagattgattttctgatttctttgcattggttttcagatttctcttgcatctcattgaacttatttaaaatcaatattttgaattatttatccggcatttcaaggaattttttttattggtatctattgatgacaattgttctgttcttttgatggtatatttgcctgcctttttatgtttcctgtgtccttctgatgatttcaacctctgtctcctgggttcaagcaattctcctgcctcaggttcccaagaagctgggattactggcacatgccaccacacccagctaatttttgtatttttagtaaagacagggtttcaccatgtaggcaaggctggtatcaaactcctgatctcaagtgatccacccacctcagcctcccaaagtgttaggattacaggtgtgagccaccatgcccaatctttgttccagtctttgggtggggcacagcctagcattaaactctcaaaatctttgttttcttaaaattgcttttgtaggagagaaatttttcctcaggatgtatgtatgttgttgattaagatacgttggctttgattttgggtgcctgaagtactgtgatctttgtatgacttcttcagtagtacacagagtcaaaggtctgtgtgatttccttggtgacttagggtacagttattagttgaagttgtgatgaagtttagctgaagatttggatgccaactgaaccagccttcaggccctggtggtggcagcagtgggttgactgtgcctgtttttaggcctcaggtcagcctccactggctctggtgtcagtgggtcctggagggctgaattttaggcttccaggtggctttcttagaacccagtactgggagtggtgggcccagtatgtggtgtgagttctcaggcttctgggcaactggtatttcatgtaggtgatggcagtggagaaacccactgggacccaaaaagtccatgttggtgttgctggaagctacaatgtgttgggcaagttagtccccagtcccacagacacctgtagcatggcagtgtgtactgtcctaagagtgcttaagagagctttgtcttctctgtccctccctgagctgggtggtagctacagcttaattgcctcaaattcagtccaagtgtggggcacagcccagcattaaactctcaaaatggtgccagctgccagcttgtgacctgagagggcagggcccatctcaggcaaatagcatgagcaagaagctgtggggagtgtgattctcttgagtctcaatcttacagaagcccatagggacagcctggcttccttgtttcacctcaaccaggtggtggctgcagccatgtcaagtcaaacttggccagagggtgggatgtagcccagcattaaactcttaaaatggcatcttgggcctgtgaccagggagggcagggttcctcccaagcagacagtgtgggcaagaagctgtggggagtacggtctactcatgtcccagtctcaacagcagccttcagcagggcagcagggacccttccaggggtgaatgggaatgtttgttctcccttctccctctttggagaagctcagcagcagcagcagccacgtctgtagatcccccggtctctaggatcaaaatgactcccagctgagatgctccagggtcagatacctacaagattctgtgtggatgccttttctggagcaacatctctgtgcaatctttaggcagctctgtatgtcagacccattccctagtaggtcgaggatttctcccttgggcaagatgacaaaaccccattttggagccctagggttttctctcttactgtttcctcatgtgcaggagcctctcccagctctcagtcagttcccagctgagcaagctgcctcaaaccctctacttacttactttgggtgcttccgatctcttctcttctctggcttatcctagcattcttttctatgaaatctgttcaaaatgtgttgagattagcatttgagtcaatagcctgaataaggcatcttgcccttcccaatgtaggtggacattgtgtaatatgttgaggacctcagtagaacataaggaagaggaagtaggcatttattcattttatctgtctcactgtttgagctggtacatctcatctcttcttccgccttgcagctgggctttacatcatgggctcccctgattctcaggccttcagactcagactctgagttataccaccagcttccctgggtcttcagcttacagatggcagataacgatatgatgggatttttcaacctccataaccatgtgagccaattcctatatgtattaacatatgtgtgtttatatgtgtgtgtgtatttgtatacatatatgtttatatctgtatacatatatatgtgtgtgtgtgtgtatatatatatctgtatacatatatatgtatatgtatatcctattggtctgtttatccagaggaacccaatatataacctaacgctgttcaaagcatctgcactcctatttggagtttacagcaatgtagtaatatgagtgaacctttaacattctcatttcacaggttaagaagtgcaggttctaagaagttaagtgatcttccaaggccacatggagacttaaattgtgagaagagatgaggacccaggtcttctgccccgaaatctagtgttctacccacagcaccccaccaacttggacatgtgagagacaactaaaatgcttgcaaatagtagacaactctgtctactattacagtacacaactctgtcaggctccccaggttaggtccaagattaataaaagtcagacacccaagaatgtcaccctaagtatctggaagcccctgacttctgatttcttgtccagcaaagatattataattgatttggttttctgtatatttgccttctgaagtcatccagctattcattcagtcaataataactgaatattaatagaaaatgtgttatgtttgttgattaaacatatgcctacattttcttgggggcaaataagagatttacatggattaaaactattaaatttacatttacaagtatatgccagtagattaaaatcagttgacccaaacccacgcaagttatccaccaacttgatatcaaagtataatactacattctattctagtagtttatttttacaaacatttatttttaaaataaataactcttagattttaaaataccaacaaaaacattgtttaaatttcctgagaaactcatcatcattaggaaataatgcatttatatttagagtcaaattacacttgactaagactttatggattcaataacctacttcaggaaatactaccccacaacatggtttcttcatatataattaatgttttctaaagttcttatttatttatttatttatgttttaaaaatctgttattgatttcctgccctgagccatgctggacactggggacacaagagcgaataaaacaaatttaaacaatttttagaatcgcccaccctcatggagataacattgcaggaggtggcacagggacagatactgaaaaagataggtaggtaaaatgtaaagtatattagatcgtgatcaatgctgagaggaaaagtaaaggggggcaagccaggtagaaggagctgttgtttagacagggtgaccagggctcctcatttgcccagaaaagtctcacgtcctagaaatcctcagtcccaggcaaaataggatctttggtcactctaaatctatattgagaggcaagggaagacatactatgaaaatattctttcagtaaaaagaacacttccagtagaggaaacagcaagtagaaagaccctgaggcaggaatatgcctggcttattacttgtgcaaggtcaaggattagcgagggtggggcagttgtgagcaagatacgagatgaagagaagtatgaggctgcaaggtgtttcagagaaatgctcaatgtcctccacaggaagaaggaacaccgtcagtactgctagctttggctgggaagaaacttactctggattctggctgttcccagtactcacttctggtacttctggagaagccaaggggcaaaagggggcaagaataatagttgaggaagaaaagggaaagaaatgagcccagccacaaggaaaggctcttcccacaaatccatctctctttggagagtcttaggttaaatccttgaaagtgcctgcatatttatcccatctctccattttttcttctctgatcttgctcaactgggctccttctgtttgttgacaactcaggattttaaagttagtactaccaccaggcattcctgctaatggaagaagtccaaattctatttggccacgaatacaattacacccacagaagtgtatttttgctcccagcttcagtcttctttttgccaggtagataatttatacagagctggaaaaagattgtttggggcaaatgacacaatacatttgccacagatagacacagcctcatatgtgaaaccaagacaatgagcagttcacttaacttttcaactcccatttcagcatcctttttaatttaaatggagttgatatttctttaccacctactagcaccagaagggtgtcataaggacacttttaaaatgctttcaactactcagatgaaagatactttatgaatattgtgtgatgctgtcactgaatcttcattctcactagcctatttatgtgtctttcttttttattttccacaaacataatcatgtagtatacccattgtctgaatatttggcaaatttgctaactaggcattcatgtgctccttcaggtgtttcatccatatttattgatattcatcaaataagcagggatagtaatgtagcctgtttgctttttttattttctgctactttagttgaagacaaattaaattgtctctcagatgttatcagcagctgtcaaaaagcatcccttactcagagatctattttgtattcagaaagcacaaaatcatataacacagtcactccagcagcaccctcagtagctatctagagctgtttattgagggccaactatgtgtcaatcatcaaattttttattgtatctagggaacttccagaaatgggtaaccaccatgtgacatatgtgatttcaaagactcccagcgatagccccttccctttaacttactttccaaaacagattccctctaaataatgtgagagggcacatcactggtgcctgaggcgttgagtagagtctttgcaagtaacatgagccctaaacactgccatgtgaggaatgacttaggtaagagtatgaaataataagcataagaaatgcatttgatggagattacacagactgtcactgggtatgtaagacttctgcctgataggaaataaagtgcaaaaaagcaaatactatattttaaaaaatatttcaaatcattcaatttatttatttatttttttttttttttttttttgagacggagtctcactctgtcgcccaggctggtatgcagtggcacaatctcggctcaccgcaagctctgcctcccaggttcaagcgattctcctgcctcagcctcctgagtaaccgggattataggcatgtgccaccatgcccgggttatttttatatttttagtagagatagggtttcaccatgttggccaggctggtctcgaactcctgacctcaagtgatccacccacctcggcctccctaagtgctgagattacaggtgtgagccactgtgcccagccaagtcattcaatttctacaaatttacaattactaccttgggagagcacctaatccggcaaacatctattctttagaaattgatcactgtgtgtgtttaacatgtcagggttttcgttgttattgttcaactctctttttcttttttttttttttttgttttcgtatttattgttctcttttttaaaaaagatgaagtgaaatattttactagaaaacaaacacacacacacacacacacacacacggaaacaaaccaaaagtttgagttcctaagcctggttgttctacttgagattcatataacctctatacattttaatttcctaatctgtgaaatgcttataatattaccagcccttcctcatcacagggttactccattatatgaaataatgtatacaaaaacacttagaaaaatatgtcactatgcaaatatttggtagaaattattattttctagtatttaagctactaattttatttcctgttctggccatcaaaggttgccctgaagaaacttagaaaaaaaaccttttgcatttgcttatgcagttgcactctgccacttccttaggggaatatgtttatctttgtccagcctctggcaagcacatcactccaccctgtgtagccagagggaaagaatagtgctgaataaaaaataagggtcaatcatccaattgacattcacttcttctggttcaatcatctatttgtcatgatgagaagccacaaaactgtacttgcatatgaagtacaagaagaaaatacagagaaataaattaaaaagaaaaacctgagcaatcatcacctattttttcctttgagggaatatttctcagtccatgtttcaagaataaggtatttttattaagaatgttttttgtcattgccccaatatgtaaccttttaatgatgtaacctgcatctctataaattatatagcacgtgtcagaatcaaatgctcttaaaatattatcaaaagttgctaaatatattttgcacattccttcctaaatctatgttacatgataattgatacacagcccacaaaacatctaaaaatacttttacagctaaataaatgcctgtaatttctttctactctatggtaaatgtggaccacagaaaccaatgtagaaattcataagtataattcaggaagtaaagggaaggaaaaataagacagcggtctccacaactcaacatttacttcatctctatttactaattcacacatagttcaaagaattagaacccattagaattatgcccttttatccccaatgatatggaagggttttttggttttttttttattttctgagtcaggagattgctttccatttgaatttaacgaatatgaagaaacggcaaacaacttggcttcacactgttacttacccctcccaaaaccatttttcctttctccttcccaacagagtgatgatttccttaggtatctatgccttttccccacaattcaggggaggatattccgacctcttgccctctctaagtgttatctctccattgagcaaacaaaacgttgtgtaagtcttcaaactgcttttgggccagtgtaggaaatgacctaagtcatgccaatctgactgaaaggaacaatctaatttcatacttgaggtatgggatctcactctctcctgttggatgtgaatatgatctcactaagacatggaaaataaaaaaatcaaactcgtagaagttgagaatagaatgaatgataggcatcagtggccgggggatgtgggtggatagggaaagggaagatattaatcaaagggtacaaagttttagctatacaggaggaataagccttagtaatctattgcatggaatggtgacatacttaataataatgactatatacctcaacattgcctaagcattagatttgaaatgtcctcaccagaaaagtttgataaatatgtgaggtgatggatatgttattagcttaatttaatcattctagaatgtaagcatatatcaaaacatcaccttatacatcataaatgtatgtaattattatttgtcaattaaaaagaaaatacaatttttccaaaaagaaagaaaaatatgagaaataaaaagaaatcatatagtcccaatggccctaatgataactgcaaggggaagcaggcataggatgaagctgatgctgaatacggcagagcatagaggcagaaagaacctggggctttaaagacttagccccagctgttgtatgacaagaagactgccttactcctggcaattatgtgaagtgactttcataattgtttcatcaatttagattgtgttgttattgttacttgcagccaacaccatcctaacttatcaatcatgttccttacaatttttcttttattttctacagtttaataatgagtaggcctgttcggtagatataagtaagctcacagacataggtttgctttattgtattgtatacaaatgattagtccatcaatgtgtccaagttgctgttactaagtggatgtcagcaatgagaaagcttcatgcatttcagggtatcagttttagtacttctttcatgaagaagagaaaacctggacagtttaagagtgtacatgctgtttcatcttcctggaagaatctttgcactcttcgcctctacctgatctggctgactcctattcacccttcatggttaaatttcactgtcccttctcctgagaagccctttttgatctatgaagacgactagactagatgcccttcctgtgtgttcccacagcactttcattttatctcaatctgagctcgttagcatatggtaattacttttctgtttgattccccactagcctataagttcccttggggctgggatggtttctatttcgctgttatatctatagtctttagcataatacctgtttctcataggttctcaataaatatttacagagtgaacacaggcccaaaatgctttgaatagagtaagacagaattgcagcaaaaaatagccattacttttagaaaatttaatagaaaattaattctaatttattcattagatgatattttggaaaaagcaaaatttccaaaaaaagactttatttggcataaacttacatacttcaaatattttaataaaggtcctatgcaagaaaaagatatgctagaaaagatgctgcaagattttttaaatccagtaaactatgaaagaaaaaataattcaggcttatagcagagaaattaccctttgtcacactctgagtattatcaccagtttataatgagaaataactgaagatcgagatcagaactcattctgtgtcctttatagttgttccaaaatatgcttcagtcattctgaacattttcgtggtgttcatgaatccccagattttagaatcctttcgagtcgtttcatatgggacaatcatgcttgacgactttacagtcaagattctgttgccaggaaatgaccatttctattatgtgtgtgactttaataattatctttttacatttccatcacaagtagcattattctggatgcataccaatatagaagccaattactacttaaactgaaagcagggactaccaaaattattttattacaccataatgtttggtatcaggtaataagtacaaaaactcaggcatcactagaacttgtaaatctcctcaaaacatgtttctaatataagactttgttaaaaatagaacttgctttataccattagaaaatgtcaaaattttaataatataaattgtaacagaaggctttcaatttgcctaattagagcaaagaaagttttgttttgtttttaaagtaatatttttattcatgaacaccaacaccccaaagaggccataaagggtgtgaagagcagattttaagagaataaagcagagtcatattacatctccggagtatttacattttatttttatttgatgcctattttcatgtatttctagttttctggtgataagaagatttttccaattttatttctgttgaaagataatgatttcagttgtatacctcaagatgacacccacagaagtttttaaagcccagtaaaggtactcttagaaaggagtccccatgtataatttatttaaagcaaacaagcaacccaaccaagttaattgaatttcttttgcaactttacattcctatctataaagttttattggaaatctcttgtgatcatgactctgctccttgggtagagggttgaggaagtgacagtcaaagattttcatcttgcatcctagcatctagggccttagcttatgccaatagaaagaaagagcaagagagatctaagaaggagagatgacagagttaatgatcaggggtagcctagtaaagtcctagacctccgatcctctcataactatcatgaaaagtcttggttcacctttattggccatgtacccactgaaatctgagctcacttaattgtcacagtctattctgttattgtgtggttggttgattgactaactggttgattttgattgatggtaacagagtagttcccttattctttatgccattatatgggctaccatgctgccagtttgttgctttaccagtatttactctgaaatagtatttttctatgccaccttaatgcttcctcccatatagattatatttgccctgcagtctcttgctctagatttctgtctctcctttattctccataagtaagtcacattagaagaaaagaacaaaattgctaagcatattaaatatgaaatgatatatcctacagttatatgtaacctattttagaagggaggtatggataggaaagaaatccaaaggcagccactagattgtacctacataacagaataaaaagaagagacttgggaggctgaggcaggagaatggcatgaattcgggaggcggagcttgcagtgagccaagattgcgccactgcactccagcctgggtgacagagtgagaatcagtctcagaaaaaaaaaaaacttaagattctcaagtcttatctagtcttgagactggattatcaagtcttatctagtcttgagactggattatcaactcttatctagtcttgagaaaaagactagataaagttccaggaaagatggcatttggggcctaaatgtccatgaaactatatttcatggtgcaccacatagatcaaaaagttcatgtaaggggaaaaaatggaaagattagaaacgtgacctctgaaatggagaaaggtaaaagctgcttacaatccagatattaaatgggaggaaagtaacattaagaagcaggaaatggaagtagatggtaattgggaccaaaagagaaaaatttatcttagaaaagaaaaatgtcatcatcaaatgtggaaagaacaataaaggaaaaaattaagtagattggaagtgcaaattataagaataattgaatgggactttgaatatttagatacacatacatatatgaaatgtctgtttaacaaactgaacacagaacaatggagaagaggttcacttcagagcccctttaccgagtggaagtgagtcttaggttcacacctccatgtgcttgctaagacatcaatgtcaaaacctaatattgatattaaataagtcactaaatctttgcgaaattctgtaatatgtaactagaaataatgctctaaagatgtgtgggtaatgtgaatactcataatagcatgctgtgagtactaccataagcactttttccttcttcgatatttcaatatccagcagtgtataattatgtaatgtcaacctgttatgtttgaaaacaatacccccacaggggttggcttatatcacaagatctttgaatatgaatatggttataagaattccccttttgattatacctatgttgaaatagtttgttgctataggttgtggtagtaatacttcaaatgttatagccctttcatccaaggatttggggagatgttgctaaaaataggagagctaaaattcagtaactagaaagcctaatgttgttctttctgtacttattgtgaaacattttaaaggtaaggatttgaggggtttttttattatttctcaaattcttcttcgctatcatggagaaaaattatgctaatataaatgtagaggcaattacaagatgcatacaattccataatgaaccaggttatatataattgaagaaaaatttatatctagagcaaagaaaagaaagcaaagattcctccgaactctaatgaaaacatgttatattttaaaacatgacacgaatgagctttttgagttgccttctcagaatataactggactcatgtttgcaaaacagcaggctatgtatggagtactagggtaactcacgtcttagaagtgaatctacaactaattcacaaacataacccgctaagctcatctatgacgcacaaaggcagcctatctgcaatacaaagggcagaccaaggaggaggaagcctttaaaaccagcagaggaagaatatgatctaatccatgaagtacgaaaactgttgtacaaatgttggtcaatatattgatttgtaatgaaaattataactctagagtagtacagctcttatttcaagaaagaaaatatttatcatatttcatgtcaacttctgtgcatctcagtttgaaattggtaatatgcttttgtctctcctcagttgtcaaccaaaaacgtcacatgtaattccatatattgatggcttttagttgtgttttgttttggtttaataatacatttgagtggtagaaaactcagagtacctcagaattcaaaacctcaattttgaatttatgtttccaattccattacttagctctctaagtagctctcaaaatagctctctaaatactccataagtatttagagagacccaaatgtggcccaagcattggagtaagggttggggcaagagccatgagttggacaggtgcagtcctggccttcatggacctgacagtggggagatgaagacagactccaagaaaacaagtgctgtgagtttcatgaaaagaggtgctggagccatgaaggcattgcatggggtagctggggaaagggcaaggtaaaataaaccctgagggatgaggaggaggtaaggatcagctaggcaaagaggggagactgagagagagattagcatacttaagggtcctgaaccaagaaataacatgtaattcaagctaggccaggagagcttctactaagggaggagaccacccctcatattgtcttatgcccaatttctgcctccaaagaaagaagtaaaaactaaaagcagaaatgaaatccaccagcagacagcctggcgccacgccctgggcctggtatttaaagatctaaagatcgtcccctgacctaattggttatgttatctatagatcacagacattgtgtagaaaagcactgtgaaaatccctgccctgttccgttctgttctaattactggtgcatgcagtccccagtcacttaccccttgcttgctcaatcgatcacaaccctctcacgcagacccccttagagttgtgagcccttaaaagggacaggaattgctcactcaggtagctcagttgttggagacatgagtcttgctgaagctccaggccgaataaagcccttccttctttaactcggtgtctgaggggttttgtctgcagcttgtcctgctacactactacccggtcagcactgagggcagtagctatgtccattgcttgggctcattgacacatcatcatagtgcctagcacacagtagtcacccaataaatatttgttggatgaatgtggctgaaggatagataactagaagagtagaacaaaatgattctacagaggtaagcaaggaaccaaacatgcaaagcctaataggcatgttaagatgttgaagtttatcttaaaaacaatgggaaattctggaaggttctttgtagggcattagcatatacagaaagactgttttttctattattgtatttcatcaaatctaagatgccattgattataaaatgtaccattattttatgtgtgattaatttaaagcaaacactgttaattaaaccaggatgcaaaataaattgtaagacatattccaattttagaaaagttaaagtggaaaacaaaaaatgcatgttaaagttgacaaaatgtaatatatgtggaaagaaaatgaattaaaagtgagaaaacatgggtacaaagtgactagttaggagggtattgttatggctgcctcagttgctcaatctgttgcagaagttcaatactggaccaaagtagagacacctggaatggagaaaaatggacagaaatgggagatattcagaatgtagaactgccagaatttgcaactggtgtgtattagagtgaaaaagtcagaggtattgggtggatgctggtattgtttatggagttggaaacattagtgtggaagctctgaagagagatctgactagagatataaatttgtgatttctcagcatacagatggtgaatgaggtcatgaaagcaaaagagatttatttctcccctagggcagcagttttttaactggggcaatgactccagctgcattgcagaagtcgcattggagatggcaatgatgggagacaattaaacaaatcaaaaggttcttgaagtagtacaagagaggaaaatgagtgcctgacaaaggcatcagaagcaggaatagaaagagggttcagactccagagatattgtagaggtgaaagctcaggacttagtgactaagttggctgtggagtctgtgggaccaaaataatttataggttcctgggtagatcatgctgccattaactataatagaggtgaaaaaaagaagcagcagcaaaaataaaagatttgcaggcaggatagtgagctctgttttaggctttttaatcgctatcacctatggtgcatgcagacgaagatgtccactggacaggtagagcactgacagagaaaaacaaacaaactctctaccatgctacagcagaagcttgttcattctataggcagcaggagagaagttctgccctcacttgtcttgttcaaggagaagaggtagcatcttattgcctgacagctcaggctctacagttagaaggactcgaattttagtcttgattctactggttactggctggaagattgtggggtagacacttaacatctttgagctttggtttctttatcagtaaattgagaaaaaaatatttagctactgaagttaatttacaaattaaagaaaatataaaaattcccagaacagtgctgggcatgtgaaaaggacttgataaatgatagctatttttattacctgttttggtgtgcccatcaactctgggacaattccttccagcatttataattgtattcatttgtttaattctttcatcaactatttattgaatcctgctgtatgggagggactggtgaccatttgcttgcaccatacctctccatgtcttattcaatcatctgagtgactagctgctattttagtgtttgatgtctcacccagcaggctaggctaaaatatcaagtcctcgcacatgccagcagagggtcagatgagtttttttcctcacagaccaaatgaaaggccatgaggaagacatacaagcaagggaaagcaaacccaagcttgagccaagaacttatatttctgcagaacttatgtatttaaaagagaaaagcaatttctacatcagaaagtgagaattcctcccaatgatttaaatctctttttctgcaacacttagggaaaaattatatcattaatttgtgatcctctttttctaacatttgtaattttaatcatatttgtacctttcttccttcggggatttattcccgtttgctcctcttttgttatccttaaaaggctttgaaacagagtgattttaaagctattcttgcttacgtgcttatttttctccacttggctttaacaccaatttttaaattcttacccagagttacctgttggaaactgcccttattgtagaagaggtcaccatgatttataatacatctatatatgtattcttttgtggtttctagatttccctttgctaactttcttagaaaattcctcaatatgcctctttctgctaattgatcacttaattacctaggatttcactactctactttgaaatggcttctttttatttagttagtttttatcttcttctggtctgtgtataccaataagatatcagagagaatatcctaaatgtcactcttctattttataagactcccgacagacagccacctgttatctctccactcatggctgaccatgagcagacatggggatctttcatcagttccttcactaaagaacacacactataaaattaaaacaaaaacatacattttctatattcaagggaaaaaatttttttatatttaagttctgagatacatgtgcagaacacgcaggtttgttacataggtattcatgtaccatggtggttcagtgcacccatcaacctgtcacctaggttttaagtcctgcatgcattaggtatgtattctaatgctgtccttcccctagccctccaccccccaacaggccccggtgtgtgaatgtccgctccctgtgtacacgtgttctcgttgttcaactctcaattatgagtgagaacgtgcagtgtttggttttctggagaacaatattttttaaaaatatttttatatgatgtcagcttggcatttttttattaactgtaagaacttgtaatctagctagggatacagaacttcatggaacattcagggatcaccacaaaaaaaaaatgaagtgcaagtttataggaaaactagatagagcaaactgaacacacaaatcactcagtagggattcagagcaagggagtgtttctgatctgatagggtgaaagagtttctagggagtagaaatttgaaaaatagtgaaaaactctgctggacacttaacaaaagaaaatcatttttattcctttgaaacagacaataatgcacaggtttcagagtaccaagaaacctaaaagaccaatgaaataatttgactgaggcctaagttattctcaatccaaacaatattacacatctgatgcttctacattggtttcagctctctgattatctggatacttgtcctataaatgtttagcagatataaaccaccatacctcttgaaagtaggcaagaggtgggggaggtcaaagaaaggttttgcctgaagttgatgacactttcaaagggggaacacatgtttctttaaaactctcatggggcaaagatgtttgaaagtgaagatagcctaacatagctccatttcctcatgtgaaactttcccataagcaaagacttctgcattctttaatagaaatatgaaaccatatagccaggcacagtggtgtgtgcctgtaatcccagctactaaggaggctgaagcaagaagactgcttgagcccaggagttcaagatcagcctgggcaacatagtgagactctcatctcaaaaaaaaggaagaaatatgaaagtacaagccaacacaatttttagttggatatttcttacagaaattttccaaacattatatgttccatttgttgaaaaatgtataaattatcttttgaaaaagctcttactattgtcacacaaatctaaattgtttctcataagagtaaattattaatttatggtgagtatgtggggaaaattttttcatggatctccagaaatagggtcaaagatatgcagagaggaagcaaaagggaattctggaacagcccaaaggaaacagaataagaaactttctgtaaattttctaactttagcaaagaatatgtcaaacctcaagcaaggaactttattctctgtaaagtaaaagacagataatctattgggaaacataattatgacatagagaaaggcctcaactagggaataatttctccagagtttggttttagcaatttcaagtacaagacaaaaagctacaatgaaaaacatatgagtaaaattacaataggttttcaaaaatgtataatttattatactgtgataagtacataagaatttataccagtcaatcaagaaagtaatggcatgttgtaaaaatgcctaaattcataaatcacttggttttgaaaatattgaattttttcatactgtgagtaaaacttggaaattgcagtttaaaaaaagtcattccaaaatgagggttttaatgccagatagtctgatttttaattcttactctgtcatttactatgttacttcagcatttcccttatctgtaatacctgctgtggaaatttcttgtgatgtacataaagcacctaaaacttcctgttaagtatggtgaattgaacacacctgttctctgcttcttcccctaaaattctagattttttaaaaaagaaaaggaaaagaaaaaaattaaatgtaaatccacaaggacaacaaaaatgggagagaatatagaatacaaaagatgacaatgattttaaaatctgaaaaacaaatggataaagggtaattgtcataacatatcagagaaagctgaaacctaagtctgcaatctaattgtgccacagaacctggaaagtctcaaaaactgacaacagaagtattcctgaaggatggggatagagtgggacttaaaacaaaattttagagagatctccttccttcatctgtgctgaagactgaggtttactatctgcagagaatgaaccaggagacttctgcattcaggaacagaagatacaactgaatgtatgggcaaggtacccagttgaacacaggggcacaaagtggaagtctacattctgaatagcctttctcccaactccatccactacttacctctcaaaacactggtagccaaacttaagcccctaaggcataagattggaagattcttctcttaatagactgaataaactggctaaagggaaaagacatagaaactgaaatgagggaaaaaactgttagcaaattaagggatccatccaggaggtgctgtgtcaaaatgtcaggaattgcagaaaaagaaaacaaaaaaataaaaataaacaattgagagacacaaatcattaaaaaactaatacaagaaaaattttcaaatcccaaaagtcacaggtttccaaactgaaaagttctgttgaatttctcatctaataagtgagaaagggcctacaccaaaatacactaccatgaaaagttagtatgctgtctataaatataaagaaaaaatattaaaactttccagagaaaggagaaataaaaacatcatatatgaagtaacaattaaggtccacttccatcatgtatctttccacctaagcctgccacctaaagcaattagaaaagctgggtgaaaacagctattttaaggcattggaaatatctgaggcagccaggacttggagagccaggatcgcagagaaaaggaaaatacattgaaaatacattggtccgagcctcatattcaccagtggtttttctcctcagggcatttgctgattttcacatcttctaactgcctaccagaggaaaaaaaattctttctgaaaaagataaaatcatccagagtttctataatttttaacttacaatgtccagcattaagtaaaaaattatcagacatgccaggatgacaaaaaatgactaaaaacaaaaaaataaaaaatataatcccaccccccatggatagatagtccagatcttagaggtatcaattcacattttaaatagctataataatatattcaagggaaaaaaatgacaagatgaagaattttatcagaactgaaatctatatttaaaaggcatcaaatgaaaattccagaactgaaaaataaaataactgagattaagaaatcaatagatgtgtgtaacaatagactagactagcaagagagaaaggataataaattggaaaacagctctttagaaacaaataattcaaactaaaacataagcagaataaaagaacttaaaagccagaaaaagcatgagcatgaaatggagcacagtagaaaggtccaacaggaattaagtggaaatctcagatgacagctgtgtggtgagcataaagagcaaccagtctggattagagcaggagacagagggctctagaagggatttctacactgtcaggattccaattctattcaagaattgggatggattaatgatacctatgtagaaaagtaaaaagcaaaaaaagaggaaatttttaattttagagaaagcatactataaccagaaatgaaatacagtgtatggttcattatttatacgtaatagttatatagtcataacaatgtaaataaacattgatttaaataaaaatgattatataatttttggaagcatgagtaaggggctaaatatctatatgttaaagagatacaaatataagagaactaaaccatatcttctacagcaggacatacaagaaacaatatttaaaactgtcaaatgaagaaatagcaatataagcttctatttaggtgtatgaaagcaaacattaaaataagcagctacaaataattttaaatagtagccattggagaaaataagagaagagagaaataaaacaagggctagctttttatgagtcttgaagcattatttgatttgttaagcatgtgtaagtataaattttgtaagaaaaatttaccttaagaataaaaggtaaagaaagtctctaagaaaatgactgatacacagtaggttttctataaatgcatcttatataaattatatgatttcaaggaatgtggtgaaaggtaggtgattgatatttgttggcccaggatctttccgaaggaagaaagcattgccttgtatattccctgagtgtgtcttccgcctccatttgctggagtctctctgacaattattcagcagagcagtgccttcatagtacagagtgggcagctgcatgcataaggcttgtgatgaataatattgagtgtcaacttgattggattgaaggatgcaaagtattgttccttggtgtgtctgtaagggtgttgccaaaggagattaacatttgagtcagtggactcggagagacagacccatcctcaacctaggggggcaccatctaatcagctgccagggcagttagaataaagcaggcagaagaaaatggaagagaagacttgctgagtcttccagccttcatctttctcctgtgctggatgcttcttgccttcaaacattagactccaagttcttcagcttttggactcttggacttacaccagtggtttgccaggggctcttgggccattggccacagaccaaaggctgcactgtcggcttccctatttttgaggtttgggacttggactgatccaccactggcttccttgctcctcaacttgcagacagcctatcgtaggacttcaccttatgatcatgtgaatcaattctccttaataaactccctttcatatatacatatatcctattagttctgtccctctagaaaaccctgatacaagactgtttgacaactctgaaatattacttgcctataagtaatatccccccagtgacctgccataggacttatgagcttcttccaagctcatactctggctactggtcaaataatgaggtctattggctttatttagctgataactaaatcgtagagaaatctcaatcctttgctgattatgctgagtgatccaggattatgggggcaggcaagaaaccctccgtagaaaaagctgaaatcatttatcaaaaaaaaaaaaaaaaaatcctagctgagcacagtgtctcacacctataatcccaacattttgggagaccaaggcagaaggattacttaagcccaggggtttgagacccgcctgggcaacatggtgaaatcccatctctacaaaaaataaacaaattagccagacatggtggcatgcacctgtagtcccagctactcagaggactgtagtgggagaatcacctgagctcaagaggtcaaggctgcagtgagccatgttcataccactgcactcccgcttgggcaacagagtaagaccctgtctcaagaaaaaaatcccataacactcatatttcacctccaagtaacaatgaagtttccctaggtgatcatatatcttagtaatgacatttgtagtgtgattatgtatagttttaaatagcatggcaaatcgaatatgtacctgaagaaacaaagctagtatataatagtggttgggtgtttgttcttaggatggatggatagatgggtgaatttatattagaatgaataatgactcagatgacaaaatataatataatatagcagataacaacttaatcataaacatatagggtctgaaaacatgatagtgaggtaatatttcatgtacttcttcctccacaattttgggtcttgtcaggtccaaatagatattacagttggaagggatattaggaaatcattcagttctctttattttaacagatgaggaaaaaaactgttgctgaaccaaacttggatccactcacctggcacaataaagccaaataccaacaccaaggtttgcaggaagagaaagaaggacatttattgcagggcaccaagtaagaagaacaggtagctaacacttaagacccaacctccccagtggcttacaagcgtttttaaagacaggggtacatttcaggaaaacagaagtaataggcaaactcataaatcaatacgtggaggttatacattgacttgttctgcaaagggaggatatcttgaagcaggggctaacaggtcccaggtggatttagagattctctgatttgcaactggctaagggaacaagcctttgtctaaaaccttggggtcagcagaaaggtatgttaaggcttggtgttaacatttatttgttaagataaggaaaactattaatcatcaagtggtgctatgccagagtcaagtcatgagagcaagtcacaacagactgggtcagtgtgacgagtctagcaagattggtcgcctgcaggtgtgactgtctccaggctccttgggaagaaatttaaaacagcctgagttcagtcttcagtttctttttgcctgaggtctacctgacagtggtcagcattctccatcgatggggatcttggtttctgaaaaacaaatcaagaaagtgtgttaatatgttatcttttagtttctatggggaaccaaacaccttatggccctgacttggttggatgactattgtttaagttactattatcttcttacttattgggttattcatttactcctcagggctagctagatgcctggaatttcccttgaagggactcagaatttttcctttatttctacgcttgggtggttgcagcaggcccctaagattggtcccttttccatctcgaaagctttaagaagtcaaggtaggggcaaattctgggaagaaaatggtggcagttgggtagtattgaattttcccaaagttcaacatacaaacaaaagacaattatgatagtaaagcaaaaacacccacagatcaatgtctaaaacaaaagaggcatcccattgagcccccagatccagatgcagagaaaatgtcaacagttacaaggcatgtgtggggtcagcatttgtgtgaaaagaggtggaggagtgcctgacagacatgaggacagcaaaaccttcaaagcatcagaaagtgtcaccagctaaaacaaggcttcttcctaataaaaataaaaatgctgttttagaggtatatgttgacttacttgacatcaaaaaagattgatgagatattcttgtgcctaatctgaagattaggccacagaaaatttaaatattattaagtaaccaggtaataactgtctattagttgtcagtattttaaaatttgataagaaaataaatagcaacccaaaagacattgcttgtgtgtatgtaacattatctgtatcaatttatcaatattttaatataatcttcttttaaacaattagtttcatactctttcttggcagtaaagcaaatgattctagaaaatcactatattttaactttgaaattgtttggaactataaaactgacctttcaaaatactaatctttcggctaaatgctaaagtatccttttagcatcaggaacactttctgtcatcttggggatattgaaactgctgttttcccctcaaaatgtatgagaagaccctctagtatacattgatatggtgccccaaggataactctatttataatgtgaagtatctcaggaacaaaatctgttttcaggccgtaatgctccaaggcagaacagtgtggtctgtcccaggtgagtttcttaggtggccccctacaatgcaaattgagctgccctcaaggcactctataaatttattagaaaaatctaaaataaaaaaacacaaaatgacaaaaaaaagtttgccttactaaaattaaaactattcacctcactcaatgtaactttaaaatagagtagagcaacagttaccgtaagaaacaatggaaagcactctagcactacacaaaacaccttgttaaatataactgactaaattcaacattctgattcaaggagctgacatggttacagtgccctatgtgctttacaattattacatcgctttgtgattggacaatatgcattaaaaatttttgtagttaattgtgtcctaacttgttttaataaccttcttatcaattactttcctgtctccagacacattgcttggcaataatgctgagtaaatagttaaataaaaaccttaaactatcttttaaattctagttatttaacacatcagttctgaccatgatagagtaacagggagacatcctccttaaacaatgagaaactttataaaaatattggaaagaatcatttgccctagcttactacctgaagatagtttccagtcctcagaaaaaagaagccctgtggtctcatgagtagaagagacagaggttgaaatttagggaggctgagacagctagaatttgtgatcaaaataccagagaggagagagctacaaagaaatttccaaagatctgtggagggttctcctcaaatctttggctgactgctgatctgtacatgcaagagaagaaagtaactctggccacataaggaagccgcagaaaccattaggccaatcaattcccacagttcctacagggctggaaatagtctgtgttcctaccagccggagtggaaagaccacataattcacaaagcattaggaagggtcttcaagggcgtactgcttagtagtgaggccaaattagccctagactaaaccctgctctggatcaacctaacaacattttaaagcaagcttcaaaagaatctaactgattcctaggaacttaactgcattccaggacaatattcaacagtatttaaaggaataccaaaacttccagcacccaaaaccaaaatcacaatgtccagtatccaatcaataattagcagacacaagaagctgcatgcacaacagagatgatggaattagtgaccatgaatgtaaagaggggacaaatggaagaaatttttttaaatgaaacttttttgacatgaaaaatttagtagctgagatttaaaatatgccagatatgtcttagcagcagattgggaactgcagaggaaaaaaagaaaaatcaatgaatttgaagaaacaataaaaactatccaaaggaagcacagaggcaaaaacaaagacagaaaaaagtatcagtgacctctgggacactgtcaagttgtctaatacatgaaggaaaactgagagaagggaggagagaaaaaatatttgaagaattgatggctaaaaatcttccaaattcaataaattcttgttactttttaaatttataatatcttggagaacagtccactttccaatgattgatgagcctaagacttggcttgggcagggaaaaagccaaaaattcaaagctgttactgagaaattccatgtgacatcttaactattttactaaaaaaagaaaagaaataacagccctaagaagtgaattaaggctgaaatgtcatgtggtattttaaccttaattctgaatttccttattctaatcaatctaaatcaggccctaatgatatttaaatgtagctacttacaattcccataataggcaaacaaaagggaggttaaaataattctattatttcacaatgatgaaacagactgaatatttcaattattctacttattatagtacacatagaacaatgttctgtaatctgcttcgatatatataggctctttaaccacaccacagtgggactaatacagtcactttggttgagctgcactcgctgattcaatgttgaaataaagtgcttcacagattagcttagtctgcagcacgtaaaggtcaggatttattgtaatgtaaatcacaaagcaattttatcttgacagagattacatactgttacaatatttctcgctgaatctagtgatgcgtttgctttttctttgcaactgctgtgcaaattggaccgtagcccagaaaagaaaaagagatggcaggctgctttggctttttagaaacaacttaattctcttcatttttcaaagttccataagaaaaaataactctgaaaatacacataaaatcatacataaatacttgcaaacctttataaactctgagctccagtgcacacagatatctgtaaatgaccatccctcaaatattttgatgtgttttaggaaaggatataattgctaatgactcacttctgatcattcataccaagtagcttgatacattatttaaattacctccccttttaagcaaacaaaaacaataggaagtgctcatgtttttattgacagataccacaaacaaaaataaaattgagtgtaaacaaagcaaggtgatgattagaatgtccactgctgtcattgtctctataaccacatatggagaggtggaatagcaaaaccttcccgatttttctgtttcttcagagattgcacttaaagtagaagggattggggccagaaatcgagaagaactttttgattaccacagaattaaatgaactactcaaagagtttgaggagtctttatttctgaaattcttaagacaaggccagctcattctctgtcctgcgtcatgtttctcaaagaatcatgcatgcataaaatgtccccacaaagaattaactggcatatgtacagaattctgcccatttttgtcaattcttcgtatatagtttacattaataatatacaaaaattatggtgagtccgaggacctaccaggaaatgtatccgaggctaatctcaaactgaaattatttcttttctatttctctaatttgggccacaattagttttgtatttccaaccctggcaaagcacttttccttgaatgaaagtcacaggttattgtgtggtttattcaaatattaagtagcgtgttctttctttctggctgtgtcttataaagcagggcttcccacatatcagtccttccaggtcaaactttatacatctataatccaattatagcttgatttgctcaattttttttgttttttgttttgttttgtttttgtttttaaagagacaaggtcacccagacaggagtgcagtggcacaattatagctgactgcagcctctgattcctgggttcaggtagtcctcctgccttagcctcccaagtaagtgggactacaggtgtgcaccaccacacctgggttttgttgttgttttgtttgtttgtttttattttttttttgagaagacagggtcttgctgtgttgcctaggctagtcttaaactcctgggctaaagcgatcatcccgcctcggcctccaggattacaggggtgagtcactgtgcctggcctgcttaattgttttctttaaatcaattcaaaattttacctaggtgaatttattttaaaacaaaaattttcactttcaaaattatagactaaacatgattgatagattaaaaaaattaatgtttgctgtctaccactttaagtggtttcatgtaccaccagttgtccacattatcacattttgggaaatgcaagctatacatcgttttgaaaataggaagtatctattacagattccagaggtatgtggacaataaatgatattcatagaatgcaagctttttaataaattgcatttattcttacagtgcaaacatccctatccacaataccatgtacaattaggcacatgcacttcccatccaaaggtttcctgtatatgtcagatgagtgtacatcctggtttacctgggaatttgtatttatgggaggtttaatgacagtgttcctacagctattacaagacacaactaggactcacattcaggtctctgctccatatcaagtaatcttttctagggaattgggagaagtaagggtcttggaaggaaaaagatggggtttgggagggagaattattctgagaataagcccattccctttcactgtgtagatctggagagattagggcaggcaacggcatgtttgcaatgttctacattcccattttataagaaccccttttccattaaaactatgttataaatactgattagattgctgggattacaatcaacggaccttgtgttttaaatggactctttcgttctgtcctaacaatctaaccagactcttaattacaaattaagttttataactcagttttcacttttgatgctgaaaagaaaagaatgaggtggaggaataggaggcacccctgtttggccttggagacatgaagagaaggggaggacacataacaaaatagtcagcctgccttttctgcattaccctcctttccttttgcgccactgtgagtgttatgccaagcacgtctatcctcccagctcgcatgggggagggccaaaagctttacattacaccactggtttacaccctgagaaacgtctcgtgagctgcaaaatacactttgaagcaactttctaaaaggcacatctatatttaccaatgtgttccacataattaaactgtgaaatttgtctccagtttggcaataccttagagagatgttgtgaggtttagaaagaaaatgcctgtgaagtgctgtaagttccataggaggaaagcactctacatcaaaggtgctgttacactccttgatgctatattggtgcaacagcaagtaaaatagcgtaagccatgatgtcataatgttgtcatgcaacatcatccacagtgagagcaagaaaaatctgtttttaaaatgcctctttcccccctcctcttcagcttgttaaagcatatggtatccaaaactagttcacagtgaacttcatttctgccactgctgtaaatgaagtttcttctcaggcagatgtcagtgctaaaagtttggtgctcataaataccaaatttacataaaatctatatagcttttttcaaaagtctttcttggttgatgtaggctgattggccgggatacacagttcacttacttattcctgtaaccataatacatttctagattcactaattggaaaaacaatgattttgactgaaccacacaaatgacattcctcaaggcctccctggttgtaaatgccatgtgtcagattgaaagaaagagacaaatttagaaagttaactaagatattcttggactgttaatttaggcctatggtttcaaactataggttatcatttatgcaaaatgcatcgtttgttggtggaataagaaatgaatcttataggtattttactccctgcaaacaccatcaaactaacctgttgataaagcagatctgagttactgtgcttgccacagtaacagaggccaccaccttgacaagaagctttatggtatctcagaagaggaaagggcaaagatagggtatttatgggatttgggggatctggtttaaggtgggtctcttgctgtggaatgtgggggcttgattatgatgggtcaagattgagatgttttagtattagtagacagagagagaggagggttttgaaaaaagggttttaatgcagtccttgattagtaaacagctatttaatgctgctttaattttagtagtttaatatatgtttaaatggacttccaggaactttttgaaatgaacgataaagttatcagcaacttttatctccctgggcaaaacttttctgaaataataaaatcaagcttataaagatagtgaaataataataccacattaatgaagcaacataacagtaaaatcgaattaatgtaaattttaagctgtgtaagcatagacagctttggatctcaacacatatactaccagtgttcttcaaattcaactgaaaaatctcagctaccgaaagcagctccttttctctgaaaaagattcattttcagccactgaaacagacagtctacctctaagatattcccccttctttttttattgtgattgctgactacctttcttaagatcactgtcaattattggcctaagcatcactacacttttctacttgatttagcatatttctatatatacagtgtagtttaatgctttgaggacaaaccttgagttccttggaaacactgaattgtcagtctcacaataacaattctaatcataacactactcagcttaaaactttttagtaagcctttttgacttctggatgaagtttaagtttctatacatgtttcttgggtcatatttccttctgcttctctcttacttcaccacatctatgagtgtatacatgaatgttatacaccagttacactaaaccttgacagttccagaatgtatttgtctctctcttccttcacttgagggtcttgtacatgcagagttgtgtgtatctggaaagctcaccaattactcctttcttcttttttccactggttaattccattaaaaatcttctcagaaaaaaaaaaaaatgcttcccccaggacaccccttgcaaataggaggaaacacttcccttttgtgcttccttaatactttatacttatttccatcagcccactccctctcaaataataaggcactttttacattgtgttataattctccaattatttgcttaccttatcctatctgttagtaagcttcttgaaggcaagcacattgtatgggaaatagccctcaaatatacattttgaatagtcagtgagtaaatgaatagatagaaccttaagattgtgacaaaaaaataataaaacttgacagaatctcaaagaaattatctgagagatcctaaaaagtaaggaattctcaaagtatttgtctaacaacaataaaatttagaagaattaaacttaaaatctgcaaaaataatattagtaacattttaaaagtgtgagaatgcattctgctggtgaagctttggggaggtaggcactttcagacatcactggtacaacccttttggagaaatatttgacaatacctaacaaaactagatatgcacttacctatatgcacttaccttttaacctaacaattcaacttttaggaagttaccctgaagatacacttgccacaaaagagaaacatatatgcaaaagattattcattgcaaaattatttataatttcaaaatattgaaagcacagtaaccaaatcagcgtggcactggtaaagaaacagacacatagactgatggaacagattagagaacctagaattaaagccacacacctacaaccatctgatcttcaacaaagtcaacaataacaaacaatggggaaggattccctattcaataaaatagtgatgggataactggctagccatatgcaaaagattgaaactggaacccttcctttcaccatatacaaaaatcaactcaagatggattcaagacttaaatgtaagacctaaaactataaaaactctagaagaaaacctagaaaataccattctggtcattggctgtggcaaataatttatgactaagccccaaaaccaattgcaacaaaaccaaaaattgacaaaagggtcctaattaaactaaagagcttctgcacagcaaaagaagctagcaacagaataaacagacaacctacagaatgagaaaaaatatttgcaaactatacatccaacaaaggtccaatatccaaaatctataaggaatttaaacaattcaacaagcaaagaacaaacaaccccattaaaaaatgggcaaaggaccagaacagacacatctcaaagaagacatactgagaccccaaaagcaaatgcaacaaaaacaaaaataaataaatggaacctaattaaatgaaaaagcttctgcacagcaaaaaatcagcagagtgaacagccaacccacagaatggaaggaaatatttgcaaactatgtattcaacaatgggctaatatccaggacctgcaaggaactcaaacacatcggcaagaaaaaaaaatcccattaaaaagtgggaaaatgacatgaatatacatttctcaaaagaagatatagaaatggccaagaagcatgaaaagatgctcaacatcactaatcatcagggaaacgcaaattaaagccacaatgaggtaccaccttattcctgcaagagtagccataattaaaaagttaaaaaacaatagatgttggcatggatgtggggaaaaggaaacacttttacactgctggtgggaatgtaaactagtacaacctctatggaaaacagtatggagagttcttaaagagctaaaagtagatttatcatttgatccaacaatctcactactgggtatctactcaaaggaaaagaagtgattatatgaaaaagacacatgcacatgcatgtttatagcggcacaattcacaattgcaaacatatggaaccagcctaagtgcccatcgaccaatgatagataaagaaaatgtggtgggcatatatatatggagtatgactcagccacaaaaaggagcaaaataatgtcttttgcagaaacttggatggagcaggaggccattctaagtgaactaactcaagaattgaaaaccaaaaaccatatgttctcacttataagtgggagctaagctatgagaatgcaaagacatacagagtgatataatggactttgaagactcagggaggagtgggtgggaagggtgagggataaagactacatatggggggtacagtgtatactgctcaagtgacgggtgcactggaatctcagaattcatcactatagaatttatccatgtaaccaaaaaccatctgtactccaaaaactaattactaaaattcttttaaaagacataaatgtggccaacaaatatatgaaaaaatgctcaacatcacaattcactagagaaatgcaaatcaaaaccacagtgaggtaccatctcacaccagtcagaatggttattactaaaaagtcagccaggtgcagtggctcatgtctgtaattccagcactttgggagacagaggcaggtgggtcgcttgagcaaaggagctagagaacaacctgtgcaacatgggaagaccctgactctacagaaaaatacaaaaattagctcggcatggtgggtcaggcctgtagttccagctactcaggagactgagatgagaggatcatttgagcctacgaggtgaaggctgcagtgagtcatgatcacaccactgctctccagcctggacaaaagagtgagatcctgtctaaaaaataaaagaaaaaaaagtaaaaaaaaacaaaaacaaagcaaaacaaaaaaaagtgttggcgaggttctggagaaaagggaacacatacactgctgatgggaatgtaaattaattcagctactgtgaaaagcagtttggagatttctcaaagaacttaaaacagaactaccattcaaccaagcattcccaccactgggtatatacccaaagaaaaataaatcattctaccataaagacacatacacttttgtgttcatcacagctgtattcataatagcaaagacatggaatcaacctagatgcccatcagcagtgtactggataaagaaaacgtggtacatatataccatgaaatactatgcagccttaaaaaagaacaaaatcatgttgtttgcagcaacatggatgcagctgatggccattattctaagtgaacacgtccttcttctcatggtggcaggagggagaagaatgagaattgaacagagagtccttataaaaccgtcagatctcatgagaacttactcactatcacaagaatagcatggggtaaactgcccccatgattcaattacaacccactgggtccctcccatgacatgttgggactatggaaactacaattcaagatgagatttgggtggggacacagccaaaccatatcagtaggattcagaattagatcctggactagcaaaagaacattaatgggaaaatctgagagattttaataaggcctgtaaattaattactagtatttggttaatgttaattttctgattttgattattatactatgattatataagatttcaggagtttaggaagtgagtatgagtgaaagtgatttgtgtgttctcttcaaactttttattaaaatttaaaatttaaatatgtgcaaaccagtttgatatcctagtaaaatatatatatattttaatgagactactcaatatatctggaatattctataaaccttagcctttcatgatttgtttttcaattgctaaggcaaaatttctaaatcccaaggaaaatagttttcctttctgtgattttctaatataataccaacaataattacactctacattttgtagtgctttaaaatttctaaataataattacttgtatatgagattattgtgttgcttccatagataatatttggactacctaagatattgtatatgatattttatgttaaccaaagtatcttctacacattaagtgcttaataaattactgttgttattattattattaatattatcctcttcaccttttgttctaaatcacaactttataaggtttgtagtacacctattattttatccattttggagattagaaaaaagagtcaggtaggtaataacaggggatccaggtttgaagccagatattctgatttagactggatgtctgatctccccatgacatctgcaaggcagtgaccaagccttatgtttcacttctgtaaatcttcctcagagtctaacacatagccaaggctcaaccaagactgccttttgaagagacacaatttaaatgtggattaacttcttagaaagaaaaaaatattaaactaagaatagaacacaggttccctgatttcaatggttacacaccccttatatgtgtgaccagcatcagagtaatttaaaagaaaaatgttataaaatattattactaggttataaaggagtaggatatattaatcaattaaccaagaaggtttattttctgtaagtagtagcttgtgacatagggtgggaatagcaaggttaagtgggaaagcatagcaagggtgtatgaatcaaaatgtcttggagataattttcagatcattttctttttttttttcttttttttttttgagacggagtctcgctctgtcacccaggctggagtgcagtggtgcaatctcggctcactgcaagctccacctcccaggttcacagcattctcccacctcagcctcccgagtagctgggaccacaggcgcccgccaccacgcccggctaatttatgtttgtttgtttttttgtatttttagtagagacggggtttcaccattcacaggatggtctcgatctcctgaccttgtgatccgcccgcctcggcctcccaaagtgctgggattacaggctgagccaccgtgcccggccaattttcagatcattttcaaatgcattctcctaggacctgccacaatctgtaaggggctggactctaccttgtaaggatgtctactttaaaaaatctccagtttattctatgagattattttctttcgtttgtttttgtattcccttttctttcactgtttcttttatttaatttaaaataattatacaaaatctgcatctattttaacatgtcaaacaagaaagtacctttttttaagttaataattccctttctctctcatcctcctacaaatcccaaccccttgtattaattaatgttaatattttagacttccctcatatttctttgattttatataggtaatgttgatatatagttcatacaagcacacatatacaaatctcacaaaacctaagtgaaaaaaacaagatgagaaatatgtaaaataaaataaattactagtggcaaggtagaacacaaaaaattaacaggcatattcaaattaggtgactaaaaaattaattaatttaacttttacttgacttttgattttactttacctgggtaagcatattcagcttcctcacccttttctggagggtgtttagtatcaaagcatacacattattttatatcatgtgctctaataccataagtggaaaaaaaggaattatttcatctgcttcattgtttaagtcctctttctctttacctagtatgaccattacaaataaagattaaatactgcatacttcaatgttattctcaggaataatttccaacattaagaaggaaggtacagttttctgttttatgaccttgtaatagagattggtaaataactagagacagtattcctttgccctccacgggttgccctggaaacaggagggggaaaaatgtaattctgggctccagtatcagcctcagatgaattcctttatttcacacaaaggttcaccattctttagagagttgcattagcggatattcatgctaatggtggtgtgacaattactcaggtgctacctggagcagctcttctaaagttgctttgcatattatttaaatcccgtttttatttaacttcccaattgtttatcatctccccagccagtgaatcaaagttacctgaggaaaaagttcatatcttataactctcttctttgcacctctggaagcatgtgccacagctcttgcttacagaaggagatatggtttgagtaagaagtgctccttaccttgcaagtttaaaacgtgtttccttacaaaggaagataaatcaatattacatgctacaaatagaaaggacagccaattaatcagaaaaacacctctttgattcaaactgcctattagaaaaatgtaaacgcaaatgggaatttgaaaattttaaatacctttagtcaaattaaattaatctacacaaactgaaattagttgaaaatgttataagaaaaaaagtaaacaggactgtaagcatttatttgtttcatccttacaattaccttataatataggcattattatccccttttaacagatgagaaaatggtgaggttcagagaacttactaaatttgctgagacatttagctaataagtggcagaaatggaattcacattcaggttgatctcaaagctagtgatctttctactataccacaaaaagaaacacccctaataaaatctgaaaataataaaatcaaaatatttgaatgaagttttaattatattagaactaaaaaccgcatgaaaggcacacacacattaaaaaaaccatagataggcaaaaccaacacaaattgcactgtactaaaagtaaggatgcctgagttctagactacattgctcactctatactgtttcactcttagcataatgcctggctcataaaaaaacagtcattaaatattcattctcactcactgtgtgactaaaatgtacaaatagaatctttaaaatagaatcaatcaaccaaacatattacaataaagctttaattaatcaaaacaattagaagattatttgttttaatgtaatgtttggttaactagtcatgaatgagtaaatcctttttgtagattcaaggttgccactggaaatctttcaaactctgttttactatatagagcaaactttattgtatagaggaatcaattaatgcacttgctacaagaaaaactcttagactccacttcaagaaatttcactcaaatttagtatgtatgcctagggtagaacactggagttattccaattcaggagagctgaagatgaagacaaagctttgagaagcattaagtaaagaacttactatactgtattccaactgctatctgaagcatatacattgcactgtgtcagcctccttctcttagaatgaatattccatctcattcagagatgggtcatatcagccatatgttgttcagtgacacggtcacatgggccactattaattggaccaggtaattgtggccaaagcttctcttttcaggaaagcgtttttagaattaagtaattctagtttctctcttacagtggtaaaaactgaggacatgaatgcaaatgcttatagatgtgactatgggattctatggatgttctcttcaactttttcagtaaagtaggaagaaaagtctttagctgagaaagaaatggaaagtattagaagtatgatatgaaaagaagtgtgaaataatcatccatttgttctcccaattcctggactaaggatgtatagcatggttactaggcagcattagggttgcacttgaggtttgtgatcatgagttaaaatgaaacccattagtaggactgtgtgttttttactaaccacattcagcttcatgcgtgcaggcatggaacaagtggaaggttggatttaactaggaatgtggctttggctcagcaaggacaatgaatcaagaaagccaaaatggtatcaagggaatgtgcaagggggaattataattgatttaagctaagtaaggaagggagagaggatatgaagatgttgagaagtgaaatggtgaaagatcaatggattaaagttcctaatggggttaaagaattataattattggagtccaggtactagaggagaaagagggaaatatagcatgtgattgtcagagagtgggatgcatgaaattgaaattatgaagaagttatagtaattagtcaagatctaagttatgactataggaattaatgattaaggtaagtgggaaggcaaaatcactgaaggagacaaattcaaagaactgaaagatcaaaatgttgaaaaagtatgtgattgacattaccaagaattaagatctgaaatagtattgatgaacagggaaaggtgatgtgaattatacgtaataaagaatttggctggattttgtcccctgtttctagaaggtagtccttaaaatttcccaagtgataagcgtgtctttgttattcacaatgggctctgatactttatgctgatgaggtgacttatggtgggcttccagatagtttgtgccaatgaaatgactcaggatacaggtggctactccagaaagatgaaacatgtgattagagggttggagatttgagccatgtgatatcaccttgatgagggagaggatgagccctggagactgagttcaatgttggccagtgattcaatcagtcatgcctacataatataacctcaataaacactctgaacaatgaagctttggcaagcttccctggatggtaacagtctgtgtattgctacacaggaggcaggagggtgccaggagggtgatgtatctctgactccatgaggagaagacaccagaagatttatgtctgggagcctcttagacctatacattgcttcttttggctaattctgatttgtatccttttgctacaataaaactataaacataaggaaaaaaacaaaactgaggccatataaattctggaactttggaataactattaatatattgtattaatccattttcacactgctaataaagacatacctgagactgggcaatttacaaaacaaagaagtttactggatttacagttccatgtggctggagaggcctcacaatcttggaagaaggtaaaaggcatatcttacatggcatcagggaagagagagggcttgtgcagggaaactcccatttttaaaaccatcagagcttgtgagactcattaattctcataagagcacaggaaagaccaacccccataatttaattacctcctattgggttcctctcatgacacatgggaattgtggaagttacaattcaggatgagatttgggtgaggacacagccaaaccatactattttgcccctggcccctcctaaatctcatgttctcacatttcaaaaccaaccatgccttcccaacagtctcccagagtcttaactcattttagcatgaactcaaaagaccacagttcaatgtctcatctgagacaaggcaattcccttctgtctatcagcctgtaaaatcaaaagcaagttagttacttcctagatacaatgcgggtacaggcattaggtaaatacaaccatttttaatgggagaaattagccaaaacaaaggggctacaggcttcatgcaagtccaaaattcaatggggcagttaaatcttaaagctccaaaatgatctcctttgactccatgtttcacattcaggtcacactgatgcaagaggtcagttcccatggccttaggcacctccatccctgtggctttgtacattatagcccctctcctggctgctttcatgggctgacattgagtgtctgcagcttttccaggtgcacagtgcaagctgtcagtggatctaccattctggggtctggaggacatggccttcttcttacagctccactagttggtgctccagtagggactctgtgggacctccaaccccacatatcccttctgcactgccctagcagaggttatccatgagtgccctgcccctggagcaaacttctgcctgtacatccaagtgtttccataaatcctctgaaatctaggcaaggttcccaaacctcaattcttgtcttctgcacacccacaggaccaacaccacatgtaagccaccaaggcttggggcttgcaacctctgaagcaatggcctgagctgtacctttgccccttttagtcatggctggagcaactgggatgcaggcaccaagtctctagactgtacacagcagaggggccctgggcctagcccatgaaaccattttttcctcctaaacctccagtcctttgatgaaaggggctgctgcaaaggtctctaatatgccctggagacattttcccattgtcttggggattaacatttggctcctcattacttatgcaaatttctgcagccagtttgaatttctctgcagaaaatgggattttcttttgtatcacattgttgggctgcaaattttccaaacttttatgctctccttcccttataaaatggaatgcctttaacagcacccaggttacctcttgaatgctttgctgcttagaaatttcttctgccagataccctaaaacatctctctcaacttcaaagttccacatatgtctatggcaggggcaaaatgccaccagtctctttgctgaaacataacaagagtcacctttgctccagttcccaataagttcctcattttcatctgagaccacctcagcctggactttattgttcatattgctatgagcattttgggcaaagccattcaacaagtctataggaagttccaaactttcccacattttcctgtcttcttctcaaccccccaaactcttccaacctctgcctgttaccaagttccaaagtcacttccacattttcaggtattttttcagcaacacacaatttgtgttaccagtttaatgtattagtccgttttcatgctgctgataaagacatacctgagactgggcaatttacaaaagaaagaggttgatagatttgcagttccatgtggctggagagacctcacaatcatgggagaaggtgaaaggcacatcttacatggcagcagagatgagagagagcttgtgcagggaaacccccatttttaaaaccatcagagcttatgagactcactcactctcctgaagagcacaggaaagacccaccctcataattcaatcacctcccactaggtttctcccaagacacatgggaattgtgggagttacaattcaagatgagatttgggtgggagatacagccaaatcatattatacatgggaaaaaaatcaatctgcagagaaaaaaagtaaatcagacataccaaggaaagtgtgtccaatcttagaaagttgcttcgtaattatcctttttataagagcatgacattccttagtaatagatgctttacaaattaataaagaatagtctttgcagtttgtgacaatttacctgaaatacaataggatagcaggtaaaccatgagtcacagaatcatacttggaaccttctagtttaacataaatgaattaattagtttactaaaaataagtaaagaagtaataaataaaaacactaagcattatccattctccaaggtcaatgtttcaaagatcctcagtggccccatttgtagatggcttttgtgactgtggcaccaaagcattcagactgttctccacacctctgttggtagctctgagtataaaagctgctgaaacaacttctattgtcttgtgaattgcatgtgacaataaggcccacagagaatgctaatgttaaaacttagacacttgttgctctagaaggggtggatattgaaagtataaactatttgatgtctgagattttaaagattagcatctcttcctaactcaccactgtatgataaccatttgcattaaaaaataaatcaaactattcacctgaaagaccaattattcagtgaatgatttgtgaatgaaagtctgcagttatgatatctaaaaatcataatttttgcttttttaactttttgcttttttaattttttgctttttttgatccaacaaaattagactgtaatgtgatgataaacaacctctaaaacatagcactttaacacaaccaatttaattatctccatgctaaatattaaaggtgaatcacaggagatttcaatcctaagtcactaagaaatcaaggctatgaaagctccattttaacacatagattcatgatgatcacagcaagggaacttaatagactacacacagactcttcacactcactcccacctctggttgacacatagcacttctgctcacagtttattagccaaaacatgtgacatagtccacctaacttcagagggggtgggagttaaacccttccacattcctggaagaagaatggcatacttgtgaatacataatgacatgttttgcatttgagcacctgacaattcacatttctcagtgagaagtaggagaatgctcctactctctctctctctctagtctttctcacctaagactcacttctagcccaaacatatcctgcacctaaaacattctgagctagattcttatgatacggaagaatccagtaaggtattctggcataggaactggcaacctgtcagaaatcaggggaagacaatttgtgtaggcaaggcaaatagtgagcccttgcttttcacaaatatcttctactgccaaagtctacccattttacatttttagattaaaagcaccataaaaacatttttaatttaaaaaagcattgtgttctcagaaatttcagaaagggcagaaaagcaacaagacaaaaatatttcaaatttcgctacctagagatatccatagtttccaaatacagttgacccttgaatggtgcagggggtttggagtacctatcccccatgcagttggaaaattcatgtataacttttgaatccctgtattagtcccttcttgcattgctataaagaaatagctgagactaggtaatttataaagaaaataagtttaattggctcacagatctgcaggctttgcaggaagcatgatgctggcatctgatctgcttctggtgaagtctcagggagccttcaatcatggcagaaggtgaagcaggagcaggtatttcacatgatgaaagcaggagcgaggggcagggagaggtcacttttaaatgactagatctctcaagaactcactatcacgaagacagcaccaagccatgagggatcaatcctcccccatgatctaaacacctcccactaggtgccacctcacagcagtggggaattaaaattcaatatgagatttttgcagggaaaaatatccaaactatatcactccccaaaatcttaactactgatagcctaatgttgactggaagccttcacaataacttacactcagttgacacatgttttatatgttgtatgtatcatatactgtattcttatgataaagtaagctagataaaagaaaatgttacaggaaatcataaggaagagaaaaatatttactattcattaaatggaagtggattgtcatcttcacatagagttcactgaggaggaggagtaagagaaaggttggtcttacagtctcaggggtggtagaggcagaagaagtggagaaggtggaagaagaagcaggagaggcaggcacattttgtgtaaatgtatagaaacacatcataatttctgtctgatgtttttgctttttcatttctctaaaaatgtttttatatagtacaaatccttctcccaccatttgctttagtttcaatgtctatatcattgaagaattcatgtcactaaagaaattaaaaacagtcttgaatcattagtgcccttctgccaaaacaaatatcaatttgttttctggcactgcttcttccacgtcttctggctcatcatctggcactggtttggaagcacttatcttcatcaaatcatctcctgttaattcctctgatgtggtgtctattaggtcttgaatttctccaagattcctatcttaaaacccttcattcttcacctattttgccatatccacaatctctttcatgatttccttgatggactctgtcataaatcttgtgaagtcatgcacaacatctggacacagttttctccagcaggaacttattgtttcaggcttgatggttttcacagctttttctatagcaacaatggcatcttcagtggtgcaatccttccagactttcataatgtcctctttatcagtgttctttctcaaagccttgaaaatggtttccacagaatattgcatataatgaaccttacaggtccttatggcccccgatttagagcctgaattagagacattgtgtttggaggaaagtagaccactttagcacagttgatgttgaactcatgcggttctgggtggccaggggcattgtccaatatcaaaagaactttaaaaggcagtcccttactgtcaaggtacttcctgactttaggagcaaagcattgatagaatcagtcctaaaaatggagttcttgttcaggacttcttgttctacaaccaaaagatttgcagctgtttcttaactttctcttcaaggcttagaagttagcagttttataactaagggcagtcctcatcttaaacccaactacatttacacaagggtagagttagtctatctcttcctgccttacatttcggtacttgtttctcttccttactaatagatgtcctttatgtcatttttcccctaaaataaggcacttttatctgtattaaaaacttattcaggcagataaactttctcctcaatgattgtcttcatgcacctgagaatttgtatgctgcctcttggtcagcagaagctacttctcctctcatcttgacattttttaagccaaacctctttctaaattatcaaaccatcctttgctggctttaaattctgcagttatagattcttcacttgccttttgctttctgttgtcatataatgaccttgctttctctcaaatcatattagagtctatagatgtgcctttcttatagcaatcctgtaagcagataaaagttgcattttcaatactatataaaaaggtatttcacaataagtgaaaggttttcgaacttgcttgcctagctgtaataacagcttcatgactttccttttcttttattatagtggtgcttatgctggactcatttatcttgaaatggtatacaactgcatctgcagacctctatggcacattttaagcaattcaactttctcttgtaatatcatgacttttcttggcttcttgggagcacttgcagcatcactagtggtacttcttatgggtcctgtgatgttagccaaggtttacagtatcgcagaaaacatgatgaaaaatacacaaggatcacaagagatcactttttacttcaataagcaacttactggagagaggtactgctcacgtggggatgattggtagtcacatagcattttaagcagacatttgcaacacttcagctcaccacaataccaaaggatgggggttaaaatattattaatagtggtgcagtattattacagttcattgtatacagttgtgatttaatactgcatctttatgtttgtttacatttctttcaactgtgaatggcaccacatacactctgtgtgcataagttctgatacattttaactttctataatagatttgtgtgtattttttggtcttaaataataaaatagactagtgtttacatgtattttatgcattcatggcataccttactttttttatttttttatatttctaggccatgtggttggtctaggagtttttttaaactgtcacaaatctccaaaacattttccagtatatttacttaaagattcctcacataagtggacctacaaggttcaaatctacatttttcaaaagtaaactgtgcatggaaaaatttctaggcatttgatagatgccattccattgtgcatttaagattatagtttttctggccgagcatggtggctcacgcctgtaatacctgcactttgggaggccaaagcgagtggatcaccagaggtctggagttcgagaccaacctggccaatatgataaaatcccatctctactaaaaatacaaaaaattagccgggtgtggtggtgggcaactgtaatcccagctactcaggaggcctgaggcaggagaatcccttcaacctgggaggtggaggttgcagtgaactgagatcacacaactgcactccagcctgggcaacaggagcaaaactccatctcaaaaaaaaaaaaagagagattatagtttttcttcattacgcaaaaaaaaataatgatgcaatgggaatttatgtatatcaatctttacatatatttctaagattaaattaattaaaaaaataactaagtcaaaaagtatggatttttttctttttttgagacagttttcctctgttgtccaggctggagtgcagtagcatgatgttggctcactgcagcctctgcctcccagtttcaagtgattctcatgtctcagcctcccaaatagctgggattacaagagtacaccaccactcccaactaattttttttttttttttttttttgtagcaatgagattttgctatgttggccagactggtctcaaactcctggcctcaagtgatcagcccacctcagcctcccaaagtgctggaattacaggtgtaaactaccatgcctggccaagtacggacatttttaaagttcttaatggatattgctcacttgcaaaatccatgagtttaggaactttatcttatttgcctctgggtcagtagaaccagaaaagtgatgaacatatcatagacactcactgagaatgtactaaattaatgaattaatacatcgcccaagggctttccaaaataaatagcactttcaaatacaatcattcccacaggaagttaaatctattgcttgtcgccatcttggtctgattcattatttagctgatttatttcttcctaatactcactaaaggaattgctatatttaataggaaacatttgctgggaggtagctgatgggaggacacaaacttacttttccctgcaattccccaagagcttttcttgggactttaagattcaacaatttatttgataatcttgcagtaagaaaaagaaatacattgaataggctagaaataattgtagtttcctaaagcctgggtagggaatggatgcttatagataagcatctataagcatctattatcttttattttaagtagtataagtaactgtgtgtgtgcccatgcatgggggtgtgtgcatgcctgctaattgctacgataagatcatctacattttgttgcaggttaaatactgctcatatacctcaaattaatccacatccgaaatgcatatgtagctacccatttctacacaggaccataatcccagtacaacctttgacaaatccttcagctttcctggctcactcttctctaataatacaacaaagtatacatgtaatagtttgatatagagcttctatatctcagttcctaaattaaggcctttcacagagcttttaataatacagccccacgctcctggaattacaggcaaagttaaaaatcattcctcctttgcctttcaacaaatttcagttctctcctgtaactatgtgcatgcaaattctattaatgctaatgaaggcgatgtacatgcatacagagtggaatatatctctaaatcacactttaatctttagctacataactctggcacctgttcaaatgatacatgtgcctcaaatacacactgtatgtctgttgtttcctgtctgggtattaaaatttattcatgtatttttagtagctattacaatatttgactgacaaattttgttattattgttatacatgtgttgagttttaactgggtgctagatgtggccataaacattcctgatttattataatgcaattagaatgcaaatttgattcctgaccaggttatatttattttttaaaatggaaattttctgttgttttccacctggttaaacatatgtagtaaaaagaaaacataatgctaacaaaataaatataagtaacctggtagcttgtttctgtactgaatagtggttatctttacataattaaaaaaacattttaatgcatgcatttttaaaaacccagttgaatgaggtcatatttggtttatttatactaaaaaatattttattaactaataatttttagagaaaaagtggttagctaaacaattttacattatttttacatatttgacgttccctggacacatgtaaatctagcattagccacttctcaagagggcctcctgcacctccaccttcacattctttctttccttttccaccttcccacaatgttcccccaaaagttgaaaaaggtagataatactgaaatctgtacactatagcaaggccagaagttttatactttgaggtggaaaaaaaaggtaatattctttctaactgatctcttattctggagccccttaccaatagatacagaaacttgccaattaaatgcattcagtctctttgcatttaaaactgtaaatattcagtcagtgcaaagttcaaagtccctcccaggactattttcactttcctttcccctttcccattcctgagagagtggggcagggtgtaagccttgactcctcaggcagtggcagtagagatgctcccatgtggcgcagcagattttgtgaattcgtttgaatgtaacccagagagcccctggcctctgccacagcctccaggcataaaatccaccttctgcagaaactttgaattatatagaacctgaaccccaggccagacccattcacctatccccatccttcagccatcttatcccttacacagtggcatgattggatgtggtttcattccaatttctggacttctctgaaagacttgcaacttcccagctatgtctcaagaagctaggactaaggatcccatcactagaaactcagatgtttctatccccctcaatcccaccctacaatgctcctccccaggcttaaaccttaagtagggagccaggcaggacactcatctctgacccttccgcttctctctcttctcccagtaaaataattttctactttgccaccctatctcaccagaactgtctctaaaaacttctatttattcttccctattccatggcatttgcccttctcctccacattctctactgacataatcctgactttgttcaagtatggatcggaggtgtgtttaggggagcctgagcccctcctcaatttcagagagaaaaatataatttggattaagccaagcatggcaatttaatttctctggctagttggttaggaatggcatgtggtataattatggccactgagatatgaggagaaacgtgctgggggcttctggcaaagtgttccttttgttccgggaaggggtcctgattcagacaccaagagagggttcttggatctcgagcaagaaggaaatttgaggcaagtccattgagtaaagttaaagcaaatttattaagaaagtaaaggaataaaagaatggctactccataggcagagcagtcccgagggctgctggtcgccccaatttttttttttttttttgagacagagtctcgctctatagcccaggctggagtgcagtagagtgatcttggctcgctgcaaccctcacctcccaggttcaagcaatccctgtgcctcagcctcctgagtagctgggattacaggcacacagcaccatgcctagctaatttttctgtttttggtagagacagtgtttcaccatgttggccaggctggtcttgaactcctgacctcaggtgattctcccgccttggtctcccaaacttctgtgattacaggattgcccatttttatggttatttcttgattatatgctaaacaagtcgtggattattcatgcctcccctttttagaccatatagggtaacttcctgatatggccatggcatttgtaaactctcaaggggctggtgggagtgtagcagtgaggacaaccagaggtcactttcattgccatcttggttttggtgggttgtggctgccttctttactgcaacctgttttatcagcaagatctttatgacctgaatcttgtgccaacttcctatctcctcctgtgacttagaatgtctaacctactgggaatgcagcccagcagtccctattgaagatggatttgctctggttcaaatgcatctgacactttcttaaagagagacatgaagacaaatgaccgcttctcccacgcggcctttggatattatttatgaggaccacggcctgcaactgctgcagtcatcttgcagctatgaggagagtagccagcaccctaaggatggcagccgagacttcagaaaaacacctggtccttaataatgtcattgagtcactgagctagacatcctacctagaaccactcacctcaaggtttcttttcacgtgagataatatttacttttgggtaaacacttctagtttctagttggctttctgtggcttgcagccaaaagcacactaacttccttgaggtaaaaatgttgagagggccatagggagataaaacagaggtcagataaaggaaaatatattgaaatataatatagaaatactacttccatagcaaatgtaaaatatttcttgtcaaatgatgtgagagaggtgtggaattacatcacagtttttttcagaggtggcttggctacaagagttactggtgaatccaggttcctgtccatgaaccaggagtcccaaggagctaccaggatattaataagctagactaaatgtagcctgcatttatagaaagtgcctaatgtgccattagtccctattgatggcatcctctatagagcccccaatgtccacggtgcttgagagtctcacctgaaacctcactatccagatgaaagagacaagaaataattctcatttatcagacactacctttttggtttgtttgtgtttttatcaacattataaatatacgtagtttaggccaggcacagtggctcatgcctgtaatcccagcacttggggaggcagatgcatgcagatcacttgagcccaagagtttaaaaccagcccgggcaacaaagtaagaccctgtttctacaaataatcgaaaaactagccagtggggcgcacctgtggtcccagctactcaagaggctgaggcatgagaatcatttgagcccaggaagtcaaggctgcagtgagctgtctttgtgctactgcattttggcctgagtgacagaatgagaccctgtctcaaaataaataaataaacaaacaaacatagtttaaggagtcaacaagtttgataaacttttatttaaacaacaacaacaacaatctctttccctgcccttatattctgtttcccagaagcaacctgtgtttcagtttttaaaatttaatcttttggtatttatttccaaatctttccacaatttaataatgtattagatttcaagagctgccataacaaaataacatagactgggtggcttaaataatagaagtttattttctcacagttctggaagctggaagtccaagatcaatgtgttcgcaggtttggtttctcccgcagcctctccctttggcttggagatggttccctcactgtgtcctcatatggtcttttctttgtgctcaggcatctgtggtgcctccctctgtactcattgcaattcaggactaatcttttcttacaaggataacagtcagattggattaaggcccatcctaacagaccagcctttgaatatgggctccttctggggaaaggatgtaacctcgggcaaggtagcacattttagtcactcagctatgacccctccactacggtctttagcttttattttaaaagttttcttcatggccaggcacggttgctcatgcctgtaatcctagtactttggaaggccaaggcagggggatcatttcaggccaggagtttgagaccagcctggccaacatggtgaaaccacgtctctactaaaaatacaaatattagccagccatggtggtgcatgcctgtaatcccagctactggggaggctgaggcacaagaattgcttgaacccaggaggtggaggttgcagtgagctaagatcactccactgcactccagcctgggcagcagagcaagactccatctcaaaaagaaaaattttaaataaagctttcctcacttggtgagttttaactttttgtgcagtactaaaaagttatctgaaagctctgaatgcgacctggagcctgtcaactgtgatctatactatagggggttctggctggtcatttcattggttcttcagttgtcttttctcttgactgctcagatttcccaaagaagcatcttttgcctagacttattgtggacactctgagagctaagtggagaaagaaagattagagagaggagtctgaatattcaatatgcaaatgttcaattaatcccttttttcagcaagtattgctcctcccgacctccgcaataccccaccctaccaccactactcttcttgatgcatgtcaatccagagaggttttgttctatctgctttggagactaaccccatcaagttgggtaaaggcagttgcccacctgtacaattggggatttatttaatggcctcttaaggaaactttcaaccaatcttcctatttttagccccattttcaatctcattttcagaggtacctggaaatgccaattcctgaaccttctggatattctgcagtgtaaaagtttctcagcttttcccaagtcagcaacaaagaatttggctttctaagtttgctgagtcaatattattcattcatctgccttctagcttccaaaatttttgctatttctttctcctccattctttttgtccttgtgggtatgtacctttttaaaaatatccctttactgtcatcttagggagtaaaagtatacgtgtctacttaaactcgacttacacattttctctttccctctctctcattctctctcacacacactttttaaaatataggtagaatattctagcaaaagaaaataagtgtctttcctacccctgtctgtcaccagttgcctctttgcctccaatcccaagcaggtaatcacttttattagttctctatgtgttcttcaagagtttctttatgtatataaaatgaaatataaatatatattcttattcctccttttttacacaaatagattactataagactgttctgcattttgccattttcatctaatattgcttgaagctctttgcatatcagtatagacctcttgctcattctttttaacagctgtatagtattccaattatttagcctcccaacaagggacatttgatttgtttccaattttcgctataaaaaacctataatgaatagtcttaaacataaacaattttgcatgtgtacaagtatatccataggctaaattccaagagatctgttagatcatgtggtgtagttatttgtaatgttaccaattgccctctgtgggagttgtaccaatttgtaatgccagcagtgaaaggattctggtttatttcccctcctccttgcatttaacagagtatattacaaaaataattgaataagtaaaagtggtacctcggtgtactttaattttgcatttcattaatatgagtgatttcatatgtctaatgtaaatttttatttcattattattgaactttattcagttcttcataaggtagagttaataattttatttggagaaaaaagtagtgtgtgtgtttatgtttgtatgtgtgtgtacatgtaaccaaaagttcaaaggcatcattacaaccttgcttggccaaatgtataattgcagtatatatatttaaaaatctcttgctacatctaaagtatggtattatgtaggttggtgtttattcaggacaaggaaaattatccaaataagttatttagaacaaggaatttatcacgcagaagaatatgtctgggatagaaggcccattaacactcaaattatgagttcactaatctggtctaggttgaggaagtatgtcaagaacaatagcttgctcatatctgagatgtgttaaaattaactgtgtgtttaataatattgggcttagaatcatatggtagaaaacattacattaactgagtaacgtaatcattctcagcgtcaatttcctgatctgagaaatggacatggtaatatctgtcccacagtgttggtaaactttcttcaccactgacacccattaatataaatcacttctaatcaatgaactcagaaaggaggtagtcatataagtcagataaaaacatctagaatttagaaaattatacagctctcagaaagagaatatttgaaccgtaaaaaataaggaatattaagatatatatgactataaataaataaaatagcacttgatgctaagaaagcatgcataatctcaaagcagaaaatagaatgtctcacaactagaagtgaggcaaaaggatagatttactaactttgtgattatagaacttacctattttgtaattataaatagtatagtatgaaaatgtttcataaaaactataagcctttaaatcccagacaaaagccagtggagtaggggataagacatactgaattcgcaaaatttaggaagatatgttttcatgaaaaagagttttctctgctttctttaggtaatcttgtagatatattaaacagaaattcttctcaaataaagactgaatttatattttcacttaatagtttattctacttttaaaaagcttaactaacaaatcaagaaaacctcatattttgtttatttttctattttaattactagatataatgtaaaaataaaattataccacaagaaataccattatgtggaatataaaaagcactttttttcaaataggtgtatacacttaaaaaataaaactataatatcatgtaactgttgtgtaaaacaaatgttcttcctcagattcatttttttgttgcagcaataggtccccctggtggagattgaaaatatattttgttctatttttctctttccaagtcactatcttaatttgagtaattaagtgccattcttccttgaataaatgaataaagaaggagtttagaaggcctgtgaattgactgtcatcccttctgcaggtgaatttgtacctagtaacattcataattgcaggaatcaaacccttctgcctagaaagaacattccccaaaacataaagtcttagttgatagagactaacaaaattaaatatgcaaaataatgaagcttttaaaaatcacattcatagattataagagtctagttaatgattcctcttattggtctatatatatattcctgtatacaaggcaaatgtctccttagctgggaaagaacaatcgttgttcattgaagactcacaagacaattaccatatggaaataccatgagatacatacacccttcattgttgggttacatgaggtgataccttaacaagtgatatataatggaaggaaaaagtgtgtcaacttctatgcatgaataaaacaggagttcttaaagtgagaccagaaccatgtgttcccattcagttctaccagtggatgcccacccagaagcataatcaacttggaacaatatggaacccagatttcattccatactctcttgaaaatgaaagttccagcagtgtcagcctggggcaaaaactgaaatttagatgatactatctttttgtaactgtttcccacactgtagaggtcccggagatcccagaacatccaagatccgattatagagctgcaaatctcttgaacctataggtcaataaccactccatgagtcctttctctggcatcagcgtcccactgccgctcaccatttccctgtgactcctgtacatttcccctacataagccctaaatctctggtttccctgaggcttaagaacaactaagcagctattgatatggatggtgtattcctcaacactgaattcatcagaatcctgagcaatgtttttagatggtcaaacactacagcaatcttaatctctttaatttcatgtttcttgatttttttcagtaagtaagtagtatatggagtatgtcattgaaccaataaagagtatgtgaattaatttacacttcagaaaacctctacatccatactgtaagctgtattctaaattaagctctcctttacctctaggccctcatgcaccttttatttcatcctgggttcctagaacaaatttcttgattatataggagcaatttgactggtctgtagactaacaatattaaagtacagcagatgtctagcgttttccctcccctgtagtgctgggaaggtctcctttgggttctcaaccctactttaaccagacatgcctctcgttaactcagcacttctctaatctcgtgggagacaagggggagaaggtgagagcaaaagtggtaaacagcagcaattacttggttgggagatgagccttgtccaggtctctgctatgtttaatatggttgatctgaacactcctccatctgaccccaaataactgaagttgactgcatttgtctcttcttatttctatatagtttgtgatctgttatttctaatttaataatcttactgaatttgtgttggagaagtgtgctacaatccttttttggaaaaaaaaaagatgttacataaagtataaataaaatagaaactaagaactcttttaaaaagatttgccttttctatctctttttcacatgaattaactctttagaccctaatagctgccagcaatcaagtttagctttttgaaaataatttttaaaaacctttgactttaatataacttaggtagaactataaaccatgatttttaagctgatttcaaccaaatgttaatagcatatattttatccatgctccctaagaatacatttcctccaaatggactgaacactgccttgctcacctgtttatgaatactccaaagaaactaatctgagtttagaatttacccccaagcagtatcctagctagctaggtttgggtacaaccaacagctccttagaggccctcaagaccccagaacttccaggatcagattgtagaactataagcacttgggcccataggccaataattcaaactacagaagaagcataactataacaattaattttaatataactttgcaattcacaaaacattttcacaaacataatgtcatttaatttttccccaaacgacatgaaatagactgttaattttctagtttttaaaaatctttcccagttttttttcttgtatctttgctacagtagtgaaatcaaccaattagatataaacaaagttttctttcacaaggaaaattcttagaatccaaatcttgcttctccctctttgaaagagttattttgtttttattgccagtgttgaaaaacatcccactatcccttggacttagattagcaacaattatctcccagcaagactggtatagaaagtctcctggaaagctcagttttggctagctactcagatttaatggaacattttaaatcttaatagaaaaaggaaaatgtaatcttgctgaaagtatggttatatctacctgtttggtagaaaccttaaatgtataaactttcaaaacaatcaaaatgtatattttcttaaaaaataagccaaccccaaacctttaacctgctgttaaatttaaggaggtcctaaatggtaggaaatataatttgaaaatatttttgtcacttaacatttagtttatgtatattgagtggtctttaaaaagctacgtatcagaaataggcttccatcaataagtctctagtatttatgctctacaacagtacacgtttccatgctgtcaaacgtacatggacttttggaagaccctggggataggcagtctaggtaacaccatacagtgaaaatgatcgcccttttcagagagcacagtggtgtgttaggcaaatgttacaagcatattaaatcagaaatgttggactccggggattctattatctcttatttattttattatagaataaagaaaacctattttaaaatatccttaattaagtataaaatggaagtaaccctgctgatgtttgattctataaaatgttagtaatattcctaaaatcatcatataatgaaaatatattttacatagtctcagaatagcacaagacatatgggtttccaaagttctcatgaaagaggtaatttggatttctgtagacagttagataaaattactaataaaaacacctggtatttagagtttacctcacaaaggtaacttttaacatacaatcataaagctcagataaaccagaacctggttttattttagattttatttggcaatttttcatagcatctaggatgaagttttcaatgaatggtttaactacagtatattctgaattcagaatcaggaaaggtaaacaaattacctattccaactgaaaatctattccaagatctccaagacgcaactaagctctcatccagttggctgccatatttccttctgagatttcctgcttacaacccaaattctgcacaattctaatattaaagtgacctttactgaccacccctcccctccaaccaatgcacctcaactgagacctacaagaactttgctttaagactaccagcttgaggtccataaaccttgctccctcctcctctttggcttaatgcctaagaccacccacacaaccttctatcaaccacacttctaaatctaaagttcctttcattttaaacagtccctaaaataaaatcttctccacaaaaattaagtggaaaaatgtttccctaaattttaccctcaaaatgaaaaccttttacaagtcttcactactcaataatgtgtactttctcaataagtatttgcttaacactatttttaatgtatttattttccaaactgatctactctttcaatgtgttgtctccatgactatatagttatctaagattataagcttccagaggtctgacacaaaacactaacttacatggaatagcacataatataatgccatgctaacttcaacatgtttcatgaatgtttttcagctgagcttctgaagctcaaattctctttcatgttttgtggttttaaaggtctgatgtattacatcttgagggagtacgtaaaagtcattgttaagaagatagcatcagttatgagtgggctctagagtaaaacagctggggatcatattccaattcagttacaacctattacctccaacatgttatttaaaccctccaaatgtttgtaaaagacaatcctacagtatctaccccaaaaggttattaagattaaaatatgtaacttctctaaaataacagtggttactattcccagagatcaatcttacgatttgcctaggacagttctgatttacatctgttatcccagcttaaataatagctcccccctaccctctagctccttcattctcaaaagtaacctggttcagataataaaatacataatcagctgtgctagttattgaactacttttttccccacaactccaaaccactattctacactcaaactgtgtaatactagggctgggactgtgaaaactacatttctcctttgccacctgaatttttgttaggctccactaatagcaggactagaagataaagacataaaggcaggagagggaaagaatcttgctgtttcctgtttgtttgtaattcctgccagcattcccagagcaacagctcttcattccagtagcgacacttggtttgtctccagctttttctcagcattccccgtaccagcctcatcattccctaactatactaccaccacttaccagtggcccctccccaaatgtctgagtccctgctctgctgaagctctccccaaagtgtctagtaaccacaacctctagctcggtcccctaggcctaggggtggtagctgccacctgaagttatgtgtcctttctgcttttgttttggttctccattgtaacctattccttatattacactgttaaaattgtaatgttacatactacggttttttaaattatttttttcacattggtcatcagaacattgtaaacaatctttaaaaaacacatcgccattaaatccctaagagattttacttccagtgactagcatcaaagctcaccaggaaaccagagtaacaatgcactaagcaagtttagtaggtaacataactttctcacatcatgaaatgccactgcatggtaagtaggattataaggataaatatgacgaatatcttacctccctctttttacaaaaaaaatcactcttttcttcatacagccacctccactagtcagtattttttcctttccactctacagttactgattatgaatactagaagaaacaacaataattcatatcctactgtaaggcaagtcttccacaaacatgaagagcccagatgagcactcttctctaacccacagtaagagaagaaacaaatgtgttagtatcccaagaagaaactatgtatattaacaaaaaagacggccaggcggggtgactcatgcctgtaatcccagcactttgggaggctgaggtgggcggatcacctgaggtcaagagttcaagatcagcctggccaacatggtgaaacccgacctctactaaaaatacaaaaattagctgggcatggtggcaggcgcctgtaatcccagctacctgggaggctgaggcaggacaatcgcttgaacccaggaggcggaggttgcagtgagccgagatcatgtcacggcactccaacctgggtgacagaatgagattctgacccaaacaaaaaaaaaaaaagaaagaaagaaaaaagacaatatatccgtaaagtggcaaaaaaatagcttcactgttccaataaagtcacagaagactcacaaaactagatttacttttactgttttatttttcactttcctggaaatcaatatatttcatgatcaagacagagggaactcatcagtgtgcgacaaaaattttttaatttcaaggtctgttgccctgaatataatgactgtgaccattgaatttgtattcaaaattaagttttactctagttaacctgctgatatagtttgtatatctgtccccactcaaatatcatgttgaattgtaatccccagtactggaggtgaggtctggtgggaggtgattagatgtcctcacaatagtgagttctcatgagatctggtggtttcaaagtacttggcacttctctcacttgttcactctggttttcaccatgtgatgtgcctgctccccctttgccttctaccatgactgtaagcttcctgaggcctccccaaaagcagaagcaccatgcttcctgtaaagcctgcagaaccgtaagccaattaagcttcttttctttataaaatatgcagtcttgggtatttcttcgtagcaatacaagaatgacttaatatacacttgcttcctagataactgtttgaaatgtcactactgctatagtattccctactgattttgtgttaaatttctagtggacaacccttaatgtaatactcttaaaaggctcacaacatttaaagcgcctcaaatgatactacactttaaacttaaaaatttaaaacaagaattctaaagaaagattgctgaaatagacaactcaattccgttcctgggagagcccataacaccgagtactagatatgagtgaaggatccatataggtactatttttttctatgatcgatctccataaccacttgtttccccctaacatacacttctacaaggcagaagagcccaccagtacttggaaactgtgtctctactatttcctggtgaatcacagactgttccttcatataggtaaaacatagacttaaattatttctgtggcttacagttttctattttcatcactgtgacatgtaattgagtgataattaccttaacaaatcaaaattccaaaatttaaatctctcagtcaagaagttagaaaattcaaattgtattcattcaatttgtttaaggaaatattcagaagaaaattaactttcatacttacaatgataccaagttaagaaacataatacacaaggataaatgggtctatctgcacaatacttattccttctaaactcaaagacaggactcttaaaaaaggaattaggcttatattgagtcagcttgtattaaaatatagaatgtcaaaattgatgaaatgttaggtaatggaaaaatgtgccactctattgctaattgtatttcaatttttgtttcagaaactagtaaaattataaagggaagatttaagaaatccactcttgagggttaacagatactaggaataaaaacaaatttaccaaactttaaaattctaataaaataaatattttattaacgaaagtctggaaaatgtgtgcactaaaaagtgactataaatgttaaattaaaaaaccttcaaagaacacatatcacacattcaatttttaaaactttatataaaagctctattataaatacaaagctaaactatctgagtactaacaacacagttcatacaaagaaacttaacagtagtaaaatacagatatataagatgcttatttttggtcctttaggataaaagaactaagttggtttttttcacatggctccaggcacaaaaatagaatataagatggtaactgcaacattcttagtgtttatccttgtaattctttaaatgtcaccagtcataatagcaatgaactcctcttggtttactgtggtaagaaagaaaatgaaatagtcagaaatataaacattttattttttcagaatccacgactaccattttacactaagtatttaaaaaattttacattatgcaaaattattacattaagacatggctttttgcttttacttctttgttaggaagtggaacatgtttattaaatgtaacttcttggatgcaaaaatacatataatgtgataaacattacaaattagtattctataatattaactggggaaaagataatgttaccaaaaaagtcaatcacagtcatatttgtacatacttgctaaaacattttaaatgcttgacatttcaaggttctttaaacaaccctctttataatctttattctactagttcatttagcaaatccttcctttacaagtaagcttgaacatatcatgcatgtaaattagatttctaaagaatgaaaatataataaaattataaaaagaagttaaattattattttttgaacttttatatacttaaaagcctatgttaaagaataattaaaaccaggtcaccatacctcaaaggtatcaataaaaatggcaatttgaaaagattacagatgtaatcttaatcaccaaagtaatccagtaactatatagatgtaaaggcagaaaataatcatggataaggactaatttttagtttgccaaaattataaatatagtaagaatctccaatttataaaacataatgtttaagacagcaacctagaaataagaaatcagataatcttatagaatataattttgaaaacccgacatatgcgcacgtatcaattaagaaaaatgttcagaagatacttctggtaagtatttagcatttagccctaagacttaatacatacctaaacaatgcataaattatgaatgataattttgataatgccaaaagaaaactacactgagacttaagacctggtctctagtcacagctctgcacagaacagctctgcatctcatttccttcatctgaaaacactgaactatgagatgatgttttagattgtttaactcttatttaccatagaaggtattatatgaaaatactccattgaatcaaacatttttaagtggctagtgaatgccaacaccacaataagtgttgcgtaatatatcaaaacagacaccaggcttcctattctggaatacattaaaaccgaaatgagaaagatattatatgatattataaaattattgttaactttcttaagtgtaacattggtatcatagctttatgaaagatatatccttgttcttagtagatggatatgctaaaatattaaaggatcaagtttttgttttattattaaaatttaattaattaattaattaatttagagaccgggttatgagactggctaatcgttgtatttttggtagagattaggtttcaccatgttgccaaggctggtcttgaactcctgggctcaagcaatccacctgcctcagcctcccaaagtgctgggattacaggcatgggccatggtgcctggcctaaagactgagttcttgatatatgaaatttattttcaaatgattgagaaaaaaatatacacacgacaggtaaagcaaatgcggtaaaatactaattactaaatctaggcagaaggtacaatggtgttcattgtactagtctgacaatttttctgtttgagaatattcataatgaacagttagaaaaaattaaccaattaaaaaatgttgaggagataaaacatggtcatagggaatgaaaagaatatatactgcactggttctagaaaccacatagaaaaccggttttgataactatgttagtcagtttttatacttgaaacagaacaaatgttttataacacaaaatactatttattattaaaacaaagaccaaatcagtgttgaaaaaaaatccttcacaatggtaaaaattattactaataagaaaaatttaggtaaaggtaaatcattacttgggctctaaaataaaaatacagaatttggaaaggaagtagaaagagagctggggtgggagaataccatcagaaatacagtcaaagaaagaatagtgtatgcctcacagaaataagctatgagttaggaaaaatgcaccctccagaagctgacagggaactatgaagccatgcaatcagtatttaacatctacaaaacactatgacaaacatggtaagaacgtaatacaaaatctgtaatactccaaactactttcaagaatcttacaaattgatgtagtgatctttaacctttgcagttaaatagccatgtctgaatatcttaggaaagctatgatccctctctctttccaataaatacagttcaaatatataaaattattaatcagtttagccagtgtgcaccttcactgaagaactcccgatttagactgaggcatctagaccaaataggaagcaagagtatgttcttaagaactgtattaagagaaaaaacataaaacagccttagaatgatttgattacaaatcattttaacagtgtaatacatccatgattaaaatattcaaaatccaaaaagtacttgttacttaaagatctagaactttttcttgatctgtaaaatttcaatactcaaactgcaaattttaagtttcatatataagtttgaaaaccacaaaacacttaatttttatattgtttatatacaaaaactttaaactataatagcatttcaaaagtatttaaaatacggtcagccttctgtaaccacaggttcctcacatctgcagattcaaccaactgcagatgaaaaatatttgggaaaataacacaataaaaaataatacaaataaaataaagtataacaatttacatagcatttacattgtattaggtattataagtaatctagagatgatttaacgtatacaagaggatatgtgaaagttatatgaaaatactatgccattttatacaagggacttgagcaccatagattctggcatccttaagcgacttggaaccaatcccctgtgcttatcaagggacaactgaattccatgattcatacctaaaaacacactacttaaacccaagaaagtaaaaattagaaagtggctcaggaaattaaactagctactttactttaattgtcttgtagacaattaaaagacaatcttctatatctctgtgcatttgattttataaccttctctattaacaatatcttatatcaagttcctatatctaataaatctaccacaatgcctagcttaaaataagctttggtaaaacatttattgaatcaagaaaatatgacactttgtttccttttatactgccttctttaacaaaatttttcatacatcaaccatttcatagagcaaatcttattacaagttgctaacaataagaattttacagaactaagtagattaagtaccttagagaccatctggctttgaaggggaaaagcaaatcttagaattggaagttccaactgagtatgttgctaatacactgcttcctataatagcatgtaatttttaaaactccataaacatagaagtctagttaatattttacttcatagcccgaaaggcaatacaatattacgtttaaaagcacattctttgccattttggagatttgattttgagttctggctctaccatgtacagtattagctttgtgataacctgggcagattaataatctctcaaagctttagcttcctcatctctatatatgcatctattatacacatgtataggtataatactatatctactttacaagttattatggaaattaagtgacataattaatgctaatatccaatatagtagctgctaaataaatgttaaaaaacatcatcattatttaaaagattatccattctggcttttcaaaacgttcctttcattttttccaaaagatgtgctgtgttttattttatatatgctgttgagggggcagggggaagtgactctttctgtatcattaccacagctttatgtctatcttgtagtacatcttatttacctttaacttcacattcaccatgtttattattctatatacccaatatttttaaaatttcattgctcttagatactgaaaagcatgaaaaagtcacaaagagagaagaacactaaagtccacaaaaaagacagcaaggtctaatctttagcagtttaacatacaaataaagtggtttttatctcaacaaaacttagtttccagccaaaagattccatattaagtgtatgaaagtatcaaaacaatttgtttctctaaatgctataggccttcaatggaagtctcatgattcatagagcgttatgggaagcttttgggaaaaagatggtgtttaatatttacctgagagaatgaatcacattttagcaggcagaaattaacaattagagcattctaagattaagaaacagcaggatgaaacgaatagcataaaaatgtgttttcaggatagcatatgttgacaaaatgtgtacatacaggaggtgagggttaaagaagaaaagtgaaagaatacactggaaagtaaaatcagttactcaaggtgggatagatcatagaaggctttgaactttactctgtaggcactgaagaatcgtttcaagtgtctaaacacagaaatggcattatcaaatgtatattttaggaaaagaatgataccaagagactgaagaagagattagagacttttatatgccgaaagggcaattaggacactacaagagactgcaaagtgaaagcaagaaccacatctgcctttttcattgtgtagcaccagtcaacacgcaggacactgcacccagtaggcagccaaggcaagaataaatgaggccattataacattcctaactagaaattagggcctgaactaggacagccacaatggacaaagataaaaacagattcaaaacatttgaaggggaaaatcaatagaacttagaacttagcatgtaggttgagggagaagccattaaagactgaaattatattgaaaggctgaaattttggtggtttcaccttcagagaaaagtgaaggaccttcttgaagtataattggttttagagatctgcttcattctaaattgaatatgtgaattatttagacagaaggtccattacaagaagcagttaagtttacaaaaaagtcttgcaagtcatttggttttagaaaaatgtattacatgtgtagcatcaggaaaacctggaaaatacgtttcacttaaaacttactttctccatcaccatctttgtcaaattcttctatcatagctcgaagttcttcatcactcatgttttcacccaattctctagcaacacgtcgcaaattcctcaagcttattttacctgaatcatcatcatcaaatagtttaaatgccttgagtatttcttcatggggatctctttccaatatccagtctgtcactacagtttaaaaacatatatattttaataaacctgcataatcacaaaggcattcatttgtgaaatcaactaaatattagatgagaattaaagctgtgactgtcaacttttagtctgacaataaaatgtcaaatgagatccccaaaccccgagataaacctgaaattagaaaaatcaaatccatattttaaatgttaaccttttttatcatgagcaacttgtcttattataaaagtaagcaaaactatatcacacagaggcaaaataaaaaggactacatttataccatatttatttaagatctactattatcaagaattgtactaggctccactgacatcaagcacacaaggagtgtgtcatctacctgtggagagacataccaacaaaataattggagctaactaaataaaagctgcttgctgactaaacgtcatactaacactgattcttcctcaaatttaatccaacttcaaaacaagaaaaactgcaagagacaaaaagtactgccatcgcagacacaggcacaatctcagacagcatttgaaaattccactaatacctttgtgattagaagaacctcttggttttccaaaatttacaaagtagtaaataggatcaaatctgactatagcaggaaagcccacccaaaaaaaacctctgcaaagaaggtctccttaaagcttacccattttgtttggataaatcactctcagacaactaactaaaaataaatgtagtttcaaacctcaatggtaattgtgtattttaatacactaaatataatcacatgtaataacatagtaataagcttaagtattttcaattttaccagtctttaatcaatagccacaataaaaattaaaataaaaatctatggcataaaaattggtaagttactaaataaaattctaacagtatctaaataagtatctctgaagtaattatatacactatctgccactacaagaaaaggtatttatggcctttactatgctattaaaaataactcggtcctgttgaaggttacagaatcattaaaaaaaaaaaaaaaagcaactgcttatagatggaaaatactggaatgtttaaggaacccagaatgaaaaaaatacaatcgaagtctccaacaagctgttgttttgctgctgtttcacccgtatttggttcaataatcacctattcaaatgactattatatcatctacacatattttcaatagtttccttttatccattaattttatccaaaaaggcttccaagtaactaattgaagtatattactgtaagtatgcaaatcatcaaagctcataaatattcagtcaaaaagaagctggcatatctacagccataacaccaaaataaaataccacacttaactctatggcacatactcaacttattttgaatttagtcccaacaaaaaagcaggacaaggaaaaaaagtgttaagaaattttcttcaccaattaaataatttacatgacaggtgaaccaaaaaagcagcttgctgaaagtattaatgtacttaaagaagcaacagggtgattggggaacagatggggctccaagatgtataaattcttatcccactggtactttaattgtgttagttatttcagagctatgtgtctatatattcttttatcaatattcttccttaaaatgcagcttttcttgggaattataaatgctcatcattttggacagcaaaaacattacctaatatataactttataatgactctcctccatgccttcaggttctattcttgttccacaaagtagaatttaattataaggaatatatttattttcaatgaaaatattagtaaactgatatagaggcagttaaggtgggtttcatttatttcacaaaactccaaatttctgtccatgcaactgtattttcaaatgatttaattacacatactatcagaaatgtacttcatcaaaatactttcttagacctttaatgtgtaaaaatcacttaagaatacggcaaatccaaaaacatcacatcaaaagtaaattaaaaattattataggtaatgctagaaatacagctttaactgtatttctcaatgtctttcggaaatttctatccaaacataccagttagacatgttggactccaaactcattccactaccaccatagtaactgcagctgcctcccctaccccaaccaaaagataacagcaacatttacagctagattccatatttgaaaagcataaatcattttcagtcccacaaacttaatcaggtcctatagtactgagaatactgttttttttctaatttatttattgttttaaaacaaggtctcgctctgttgcccaggctggagtgcaatggcgtgatcccagcttactgcagcctcaactcctgggctcaagcaatcttcccacctcaacctccaaagtagctgggactacaggcatgtgccatcatgtctggctaattttttaaaatttttttgtagagacaggatctcactttgttgccccagctggtctcaaactcctgtgagcgagcaatcctcccgccttgacctcccaaagtgctgggattacaggcatgagccaccaagcccagcctcttttttattcttaaatgtattttcttttcaccctcgccatcctcagcgaaaaaaatagtattttctgtctgcagtctctcttccttccaactcatcatcaataatactctcatcagttttctttctcaaacatatcatatccccttcccttaaaaattgtgaatgatctctgctgactagaattcaaaatcttcatgttttgcaagactttaccaatctggcccaatcctatgtttccagtcatttccctatgtctagcccagaacactacctagtttcccaaacatgctatccgtctagtaccattctttgttgttgctgctttctaagcctagaatgctttttctctactcttcctggcaatcttggaatgaaatcttactcacatttccaaaggcctaaatttaaaatctcctctgcaaagacttcaattcctctagatcagggattaacaaatctttcctgtaaaaggccaatagtaaatattttaggctttgtagagggccataaagtctctaactactcactctgccatagtagcacaaaagctgcataaaagaaggggtgtggtggtgtacaagcagcagctgaatttggtccaaaggctatagttgctgacttctgtcctagacaaaattacaatttaccacatagtactatagcctgttgtcacctatatttacattgtaaactccctgaaagaagaaccttttagtaacttttaattaagtcttcttcccaaccccagtacagtacctaataccaaaaaattcagtgttaaataagcaaaatgaagacaataatacagtattacaatctcaatcagcaataataagtagtacatgtcaaaaatagtgtacaaacgtttgacttatgttagtcttaaagacactaattcctaaaatatctatgttactcactagcctcaggctgtcttgactctaaacttaaattaaatatattttaaagcttttttccagtactaggaagagtctataatagttaactgccaaacttcatccagatatatctgtggaacagtgtccttgggtagttcataaaactaggactcaaatgttatgatttagaatcatctgtcccaaagtataaaacatattaatctgtggtcagtgattagttaaaaataatcaacaaaaggggtaatacatagttcctgaatgattcccaaacagtaatacatttttatttgacacctggtactctccataggtagccttaagatagctaagatacatgttgaccctgtcaaaaggttaatcttttagtgtcaaagctgaagtttagccacatctatttattctagaaggaacccagtatttctgctctgttaataacatagaacagatggggtgtcaggaaaaagtggaggtggcatgggattctggtcccaactgccaataaaaatcacaatttttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaagaaaaaaaaaaaaaaaaaaaaaaaaatcacaatttttaaattgtgttcatttaaggtgaaataacatattttgtaaaattattagtgatgatacagtgcttacaatagcctttatgaaaaaagtcaataaaaaatatacacaaagtctattttatgtcccagtgatgcatatatgattatttcgagcccctgaaacaaagacaattttttaaagtaataataatagcaaatgcttagtagcacttacaacatgctaggcccttttctaggtacttcacatatcattaacttaatccttagaagaatctcatgagagaatacaatgatccccactttatagttgaaaatgaggcatggggtattaaaaagaccaagttccagagctgtaaagtggcaaaaccaaggtatgaaccaagggaatctggttccaagtgctaaaccactatactgtactaaacatacctggattatagctccttcctaatagtaccatttccactatatacaaacaccttgtttctacaaataaacaatctaaggtaaaactaggaatactacgatcataaacttcaggagagtgtccattctgggagaacaaaaggtggctctctccctttcctcaaataattaattctacaaattagaggaaaaaaggaaaatgtccccaatggacaagttgcctctctaaacagtcatatattagttcataagttgaggatcttctgtgctgtgttttttttctcttaggttcatcatttattttccatctcaactgcttatgacttgagcttttggatttaaaaaactgactaatgacatgaatctaaattttctctgcgtctactaattgccatttctttttgcttcccctattgcttcttgattaatatttaaaataaggggtttgtgtatatagcagaatttgtttccaaatttttaaaatatcttaaaatacttatatgatgtgcttatatcgtgacccattggtttagagaaaaaaaaaaaaagaaataaacctgaatatttacatattttgtagataatattctagacaatacatttaagttataatagcaacatccttgccttccggactcttctattttgaaaaagcctggtctatatatgctataaataattcactaaaatcaactataaaaaaatttagccatattaagcctatgacacattatcttcagttggtggtactaggatgttttctcctgcttccagtatgcccactgcctcctttactactaccctctaaacagatgactttatccactgagatcaaggtcatccagaggatgtagcctctcataaactttgtcaacctgaagtcgtgcatttcatctacagccaaagataccaactactaccagttccctcttctcccacttagccaacaaaaatcacataccagaaaggtcttgggaaacattttccaaacagcaggatatcaaattttctgttttattaagcaaaaataattttttgatcacccttcaagttttatcacataatataaatacaaacaacttggaaaagcatctttctataaaaagctacacaatagttccttggttagaatcttcacaacaaaacaaaagacaaaactataaatctcagagcaaagccatattttttctttgaaaaaaaaaccaacaaaacaaaactgagtaagagtcacattatacaccagtgttctataagaaaattccataacctagagaatttaaaatttaaaaagtgatattaatcagacaatttcctaacagctgctgattacaaagactattaaaatacacaccaacttcattaaaatcttcaaaggtgattttccctgtggcttctctgtcataatctttaagaatcttcagtacatcagctttttttacatcaaaccccaaggctctcattgccaccttttggattaaaaaggaaaagcaaattataaagcactctttacaaaagaatttctaattattaagtttttacatcttaagagatgacaacacattaataaaatataacttttttgcatgttttacctctttaaaatagcagtgatagtgtaattgttcttcactactgaaattaagtatgcataagttttttcatttataaattgcattttttatatgacaaagtaaccaacaagtgtttacagattttactatataaaatgcactaacttattgcacagataatttgattgttatttgttctgaagggattaacaatcaaaatgagaaaaaggcgtggcataaatattaaacagttacatgatagaagagataaaacattaaaacaagaattatcatcagtctttccatgattagttaccaggtaaatgatagggctaaggaccctgagtttagagaaaaaagagattttgttactaataataaggaaggagacatattactgactagagaagtcttatttggaaagattcaaactgttccttgaaggatagatgaagaggagcagtagggtatttgggaaggatgactggtattaaaagaaacactgaaacgaataggttcgaaggacaatgaacagagcagtttacctcacctgaattagaaaagttcaggtgaggtaaactgctcacctgaattaggaggtgaattccaccttaattagaagagttcaggaggaagaaagcagttagcaaatgaaaaaagtagttggtggcaaaagtgtagagaacattcagtagaaagcaaaggaatctgaactttaagtagtatacaatgaggagttatggtttatgagcaatgaacaatttatgagcaatggtgaaagaatttttaaactatctaaattcagtggtagtgtacaaggtgaactagtaagaaatcatttaggaagctccaggtatgaaataaggtcccaaaccaagatagtcaatggttacaaatggaacagacattataaaggaagatcaaatctgggtaaccaaaaaaaaaaaaaaacaaaaaaaacagtgggaaaagagagccaaagaggactgcaagattgagaaagctagacttagcaggcctattaactgcttttatacattctatcctgtcactgcatagttcctatccctacttggaattctaatgcttaaaaatcccttacgaaattacaaaaattaaaactaccaaataaacacttacattcacctatccattaaggccattaaaaatctcaaaatactatctttcccactgtgctgaaagtaagtcccattctaccctaaacccaaatctctccttataccctgacaaataataatttacaaatctctccctacactttgacattctaggtcttaaagctgacatttttacctattagcatgtgtcaacatcaaacagcactaaagttgtttgcaccagagaaagtggattgagactatgttactaacaaatccaaattataagattaaaagacaacactcccacagtctgaaaacagtatgagtcaccaagaaacaaaaacaaaaacaaaaaacagtgaaaagaagatggtaagaataaattccagtttgaaatcctttaattatgacagtgaaaaataagcaccttccctgggaatgtatttttacatttaaaatactattcgttttctcatgtgaaaaagattttctaaaaactatgttaggagttctcttcagttttattacagcatctaactatgaatgcttaaaatgccttcatagttccaaaaccaatttagttaaaataattatttagaaatgtaatgtaaagcaactgtaaaaatgcaaatcattttaacacagaaacaaatattttaaagtataccattacctttaattcatgataatctattgcttcatctttgtctgtatcaaatagttcaaaagcatctttaatttcttgtttctgttcctcagacagttctcttctttttttcctctttgttttgtccactacaagctcacttctatgaaatggaaagaaaaagcccttagtccactttaattctctttactaacagaaattagccaataattaccttctaaatttcaaaaaagaaagtactttggagaaagatagggaaactttccctttatgagtcaatgacctgtttattccatagtctaaattgctataaatctgaacttcgcaaaactaaagagtgttacagattattaaaagaaatgaggaccaaacttttctttttcccagctttttatttattcccactaatgttactgtggaagaaacaagaactgtgaataagcaacactacttttatgtctgaaactccaaccaactccaaccaaaaaaacaaaaacacgttatcctacaagaatgttaaagaatttaaaaaaaatctccaaatgaaaccaaaattcataactgacaatcactatatatcggtttactgttgatagttctgataattatgttcataaaattacaaaaaaaaagtgaattaacttatacagtattttagcactgttggttcaaaatgtttttagattacacgtttttaacagtttggcaatttatgtgtcatttcctccattgatattaacaaaccatcgaaaatattaatgagtctaaacatatgacaaatattagatgccaatatacaatgtttgtgcttcattctatataaaaatgtgatgagtcttgtctcatttaacatgtaaaccggaggttaacttctcataaactctggaaacgcttaaagaaaaaaagcaaaaattattttaaagccagaaatgttttccttaagagctgcccatctaaatgtgctccaaattttcaaatggagccgcaacactggaataacgagttttgaaacacaatccggtaacacattaacatgtcaaaccagttgactgtacttaaaacacctatctagttgcatttgaaagtcgttttggtctctgaaagctccaaaaaaaaaaaaaaaaagctaggaagtgactagtaggtgcagtataacaaagctgaggaagatcttcctttcatgagacctgacttgacacaaacttgggtattcctggggtcagtcttttccttcctgagacttttggaggccaagtccagaaccgacccacccctgaccccatccaagggtaccatgattatcccttagcagaacatggaatattttcggagtgtcgtaagtgtatggatagttttacggtacaacgtctacatagtgggagagggcaacagagggttagaggttagaactgaaaggtaaaaaaatgcaagaaatttaggaaatccaagagacagactgccaattaaagtcactaaaatgggtctccaattacaccgtaaagcagggccctgggagaagaggaaagagtttttgttatttccaaaatttataggtgggtgattgcattagcagcggagcagccgaggtggggccctgaccaggcacacggatgaatgaagggatgtccgcgacctgatctgagaaacaagagtagaagcctcgcgatatttcattcccacctcgctcgcaactaagcccaaccttctggcagtccaaagccctacgcgctgacagaaataacctccttagcagaaatgcactggtctcgttccctgcagggcatcagagcccagagggtgagtgatccgggcaggctgccctaggctcctttcccgcgtcccaaactacatcccctgcctcgcctcggccccaaacgtcctcccttccacacacaccctccctgggccccgctccggggtgtggagagcactgccgcctccttattaccgacctcagagctaaactcattatctcttcgcacagagacgttcctctcaagaacgattttaaccccctacccaaggcagcaagacgcccacagccgttcaacagacacgaacgacctcagcggcctcagggacctcccacaacatagacacttttgagctggattggttgaaatgtcgctatggttctgcctattagggggcggaagctttaccagttctattttcattgggtaggttttacgtcaatcaaggaaaaaaaaattttttttctgtgccccgcccacctcctaacgcccccccgcccccccaatctagggccgctctcgcccttcggattggctcgatgcgtttttccccgaatcctttgcgggtccggcctccgatccctgtgtggctgtttggcgggtgggcgctgtgttcctctctcgtaaagccgtgcggtctgtgggccgccattcagaaactggatggacagcttcggcggtgggaagggaagggacatgctgcaggccaccctccggctagaaggagggagtacttgaggaacaaggtctgcgaaaattggctgtgctctgttctaaaacttggaatggcctcagtacctggggaatgtgtttaaaatgcagacttaaatgtccgtttctccattctaatttcagtaggtatgaatctgcgtttttactcctcacaagccttccaagtgattctgaggcaggtgctgtggctgtacttggattatcacagggttagattatcaggctatttatgatttagctgtatctaaaccacctttccctctctttcctcctttgaactgtttgaaacggatttgttcccttctgtctcttatttttcagtgctgtaagctgttaacacacatgagactgtcttcactaccaaaccaagtctcctaaagctcacttgaatgtctgcttattcgtgtctcttactaggttcaatttcttggaggccgtgattatatctatttaacgcttttccttgtacctaataaaatgtctggtgcgtaggtgctcggtaaattgagtggaatcttttgaaaatccacaaaatactgagctaaacagcaaatctcataaacgtgaataaaatagcctgaggatgggagttgaaggcggagaatatataaacattatatgtttaagggatgtatataaaattttagagaagggagagaacacaagatatgcttcttaaaggaggtgacataaacgttagacctagaaggatgggctaaatttgcacaaggaaagatagtatgatagaataagctaaaaattagctaagggatagcacccctaaaaaacaaaagtggaacttttattttgttcgtattttaaattttaaagtacctttataaatcacctttgagtctaaaaggaaagagaaattgtagttactagaacataatgatattgaaaaaaactatatgttaaaattttaagatacagaccaagttataggagaacattattttaaataagaaagaataaaaataggccaagcatttatttgaagatgttagaaacgaagaacaaattgtataattgaaattaggaagaggaaattagtaaagataaagtttgagaacagtgttttaaaaggaaattggtaaaattgataaagtactcataatctagtataaagctggtttttggcaataccagtgaaattcaaagacttataggaagtgtaacaagaaaaggaatagtgccactagtaaggttggtaatttaataaaagggaggtttaaaaattattaaaatattttatacaattttataccgccaataaatattaatagaaaatgaaatagtcacttttcaaggaaaacataactcaaaaaaggtggaaaactgaattaagtcaataactacagacaggactggaacaaagatgccaaagttctgtactcacaaataaaaagcctccagcccactcagatttatgattaaaaatcataagagctaaatcttgtgctttaaactcaagtcatagaaaatgatggagagcttcttagcttaatttttgaagctgccataatctttcacatcctaaaagaacatttaaagtcactcagtgtaagctcagtgatgatgaaggctatgcatgtttctcaccattgtatccccagtgcctgactcatgtttgatgttcatttgtgaacttaagtgcaaaattcctagatgttagcaaagtcagtttgatactgtcttaaaggaacatttctctataactaaattgagtttttttttgttaagtgcaaagataattcaaaatataaatctgtgttaaataattataatgttaggttaaggaaatcatctcagtgtcaaaaaggcactgaataataggtaacaccttttctattaggatataaagtgggtttagaaaatacttttttaaatatgatcggcagaatacttaaacaccagtgtttctcaaacctcattcctgaaacactaggattttgtgagatgcttttggtctcagagtgcgttttataagcaaataatttgggcaaacagattttaaaaggttttcaatagggtgtccttttaagagagtgacagggaatttacacgcatcacttttattatatttaattagtgagaactagtgacaaccacttcttgcttcacgggaggttgaggcaagaaatctctagatggaaaactgctctgctgaaacttggggtctaatcatctattactaaagataagacaggtggttacactaattatattttaaacctaaatttgatgcaatcaaaattctcatatttttcttgaattgaacaaaggtattccaaagaccatctcaacaacaattctataaaaataacttactaaactgtgaaaaagaataataatacaaaaattgctgtatgggacactaaaatgtatttggtacaatggtaatcagaccagaaattccagagacagccaaatgtaaataaaaatgtctgctttgaaaaggtagtgacataaatatttgtttagtctgcctcctaaagccttaataaatcaagagttcctctatcacccacgctggagtgcagtggcataactcactgtaacctcaaactcctgggctcaaaggatcctcccgcctcagctcctgaaaagttaggactacagaagcatgccaccatgctcagctaattttttttaaattttacactgtgttgctgtgttgcccaggctggtctagaactcctggtctcaagtgaccctccagcctcaggctcccagagtgttgagattacaggaattagctcccatgcctagccaataaattaatttctaaagctgaagtgacctggagagggaccatcagcagactaggtatttaaaaaattattggaaagatcaaaagaaatatggaaacttgttgacaaatgaaacagatcactgaagtggcatcctataattttccagagatgacttatgtttcacagagagttgatctacctagcaaagtcccagagagactccaggaatagagttcccttgtacagtagaaggtggaaatgagaagggggctaaaaacaaaatgtcaatttaaaacctctttaggaaaccactgtacttcagttcctccagattcctctccccagtgttttgtctctttacatctatctagaactccactcttttttttttcctttttttagagacgggggttctctctgttgcccaggctggagggcaatgacatggccttagatcatagctcactgcaacctcaacctcctgggctcaagcaacctcccaccttgcgccttggcctcctgaagtgctgggattacaaacgtgagctacggcacgtggcctgagtctttaaaatgaatgaagaatgaaaaaccatcagagatatgaaaatcaacagcatgaaagataaaactaaaaaccatttcaggaagactctgagtcagctaaggaaccaaaataaaataataagaaattaataataataagctgcctaagaagtactcaagaaaatattagagaacagaatactctgaaaaaggagcattggagaataagaaaagactgttgaaaataaacatgaatgtaaaaattaaactggcaagatgatttaattgaaaaaatatcacaaaacttgcagtattcaaacaaaaacatggagaattttgagaaaaaaatggaggactaattcattatttgactaataagaatttctgaaagagagaacaagaggaggaggagaaaaatatcacacattgaaaagatacttcgaggaactgaagataaatacaggtctccaaattgatagaacacatttagtactgagcaaaataatagtaaaagaaccacacctagacacataaagaagccatttcagagcatcaaaaataaagaaaaaggcctaaaagcttccagtcacaagaatctgaccttttataaaagaatttaagaattgagctagtatcagatttctcatcagaaactttagataccgaaagataataccttcaaaattgtaagtgaaaattattttgaacttagaattctatttcctgtcagaacaaaactcaattatgagtacataataaagatttcagaaagttcaattatcatatactctttctgaaatatgtactccagaaaagtaagaatgaaatccaaaaataagatagatgtaaaatacaagagtgtggcagatagaatgacccatcgaagatgtccatgtcctaatccttgaaatttgttaatgttacactgcatggaaaaaggaactttgtaagtgtaattaaggttattaaccttaaaatagggagtttatcctggattatccagtgggctcagtctaatcatgtgagtcctaaaaatcagagaacttcttccacttagaggcagaaaaaatgaagcaggagaggttagagagatttaaagtataagaactctggccgggcatgataactcatgcctgtaatcccatcaccttgagaggccgaggcaggtggatcacctgaggtcaggagtttgaaaccagcctggccaacacgaaaccctgtctctactaaaaatccaaaaattagccaggcatggtggcacatgcctgtagtcccacctgctcaggaggctgaggcgggagaattgcttgaacccgggagatggaggttgcagtgagccaagattgcgccattgcactctccagcatgggcaacagagtgagactctggctcaaataaataagtaggtaaataaataaaccaagtataagaactcaatccacaattataggctgaaatgaaatgagatcatgagtcaaaagaatgaaggctgcttctaaaagttgagatgaccccagccaacagccagcaagaaattgaggacctcaattctacaaaagtacggaactgaattctgtcaacaacctgaataagctggaagtagattcaccccgcaaagcctcctgaaagaagctcagccctgttgacaccttggtaggccttgtaagaccctaagtggaagactcagttgagccacactgtacctagacttctgatttacagaactgcaacataatgagtgggtgttgattttagccactaaatgtgtagtaatttgttatgatagcaataaaaaacgaatacacctcttaagaggtgaaagagaaaagagggagatacaagaggcttagaaagcaactggtctaagataaattgatagacaactaggggaatgttttcaagaaaaaattgaatgagttccaagcagtagatagaaatggataaagagaacatgaacatactcagtgacatggtgaagaaagtatttatttattatttactctaaaggaaaaaaagaaggtaattagaaagtctttgaaaaaaactaaaatttaattggaaaattatggcttaaaaatgatgtaaactaaaataatccattatcaagctgcagtgaacattatgaagtaccacctaccattctcttttcagaaccaaggaacttatatccccagtttccatgagttttgactgctaaaaactcacaatttagttccccccaggaaattgccctccaccaaaggtatgtgccttgcaaaagattacacaacttccctggggacagaacacatccaaagactgattagtgtggaagaaaaaaggttgggctccttgcctcaattcaagggaactctgaaggtcttctccaacttcatagttccccatctagttggctgaggcgtctgttttgactgcaccatggtttaacttctctctatgcccaattcagcttcagtcagctccttgtttctgagaggctggaaatctcttatctcctaatctgtttcctagagaactcaccctaagacacaccgtaagaacaagaacaagacaaatatattagatcgccacaaatacagttaggcagcttagccttagaaacacaaattttaaaagtgaagtaaaaaacatgtttaaagaaaatgagtgaacttactagaaaagaagatgaaatatttaaaagaccacagatgtttaaagcagctttatttataatggcccaaactgggaagaaaccaagatgtcttcagtggattacaggataaactatggtacatccacacaatagactattactcacctctagaaagaaaaaaaaaacaggccaggcatggtggctcacacctgtaatctcagcgttttggaaagcctaggcaagaggatcacttgaggcccggagttctagaccagcctgagcaaaatagcgaaacccaccccactgccccccttcatgtctaccaaaaaaataaaattgtttttagggtttttttggtttgttttgttttggctttttttcagatggagtctcactctgtcacacatgctggagtgcaatggtgagatcttggctcactgcagcctctgcctcccaggctcaaatgactctggtgcctcagcctctcatgtagctgagagtacagacatatgccaccatacccggctaatttttttatttttaggagagacagggtttcaccatgttgcgcaggctggtctggaactgctgacctcaagtgatccacccgcctctgcctgtcaaagtcttgggattacaggtgtgagccaccatacccagcccccaaaaatgttttaaatagttaggcacgatggcacacacctgtggtcctagctgcttgagaagctaaggcaggaggattgcttgagcccaggaggtcaaggttgcagggaactactgtgccactgcactctagcctgggtgacagagttagactgtctcaaaaaaataaaaagaactcagtaaaaagaaaaaagctatcaagccatgaaataacatgaaggaaacttacatgcatattactaagtaaaagaaggcaaatctgaaaggctacatactgtatgattccaacaatgtgacattttggaaaagataaaaactacggaggcagcaaaaagatcagtggccatcagggatcaggcagaggaggcatgaataggcagagcacagaggatgtttagggcagtgaacactattctatatgatcctataataatggacagatttaatgatatatttgttaatacccatggaatgtacaacaccaaaagtgaatcttaatgtgagctctttacttcagatgataataatgtgataacacatcaatgtgttactggcaggtctttgttcttaagagttcccaagatggtggcgggccactcccaagatggtggcaagccttttgctctctgacctggagttcttggcctcacagattccaaggaatggaaccttgggccatgcagtgagtgtaatagctctattagaagctgtgggtcatggaagagaactgtggaacccagcgactagtgttcagcttgattaggacgaacctgggcacttagctgcacaggaacaatggtgagcctttagccccatcaggagtggcaatgggtgcctcactggatcagaagtgcagtggacaccctgctggatctggagggtggaagtcagcagcagtgtctgcaatgacagcgatcagcagtggtggacagtgagcgaaagctcagctcgagccagaacaaacagggaccagaagagtgtgcagttgcaagatttaatagagtgaaaacagagctcccatacaacaggagggcacccaaagggagttgccactgctggctggaacgcctgggtttttatcctgatcattgtccctccccctgtgctctcaggtgatagatgattgactatttctttacctcctgcttttagcctaattggtattttagtgagctgagttacaagccctgtgtttaaaggtaggtgcagtcacttccccagctaggcttaggaattcttagtcagcctaggaaatccaactagtcctgtctctcaaatgtaggttcatcagttgtcataaatatacctctctcatgcaagatgttgatagtaggggagaggttgcacaagtataggggcagaggatacgtgagctctgaaatttctgctcaattttgctgtgaacctaaaactgctctaaaaaatggtctattttcttaaaaagatgagactgttggagtacttaaaatgtattacctctgggaaatgggaaatgagacactgattacctattccaactgagaccaattgcccaattgctttttagatctgtaaaacaacagttggattccttggttaaactcactgtttctcatatttcacatcttcatcctgttatgtttcactcttactttgctggagtatatcttcaggaactcagaaatggtatatgacaggcaaattttctaaattctttattttgtccccacaactgctttcacagttgaaacagaaaatggaaaagaatgggacaggcgacttttacccttatgaactatatttagtaaaccacatctatgaagtactttgataaaaatgcagaatagaaggaaaaattcatctggacaaaatgtattctacagtccattgggaaaataaagttagatccacatttcagattttgtatcaaaatacaatcaaaacaagttgaaagtttaactataaaaaaagttaaaagaacatatacttagtttaataattttagaattcagaaagacttcctcagcataattaccaacattagaagccataaaataatgatagatctgagtacacaaatgtacttttttttttttttgagacagaatcttgttttgtcactcaggctcgagtccagcggtgcaatctcagttcactgcaacctctgcctcccaggttcaagcgattctcctgcctcagccttccaagtagctgagagtacaagcccgtgccaccaatcctggctgatttttgtatttttagtagagatggggtttcaccacgttggtcaggctggtctcgaactccaacctcgggtgatccacctgcattggcctcccaaagtgctgggactataggcgtgagccaccgtacctggcccaagtgcacatttttatataaataaaatatctttatataaataaaatacacaccaagctatttaaccagtggttaactctggagagaacaatggcaactggagaaagggatcaggaaggatcttcagtggaaagtaccgaaacggcaaaacagaaaataataaattgggcttcaccaacaaaacagaaaataaataaattggactacaccaacaaaccagaaaataaataaattgggcctcaccaaagctaaaaacttttgggcatcaaaagatactatgaagagagtgaaaaagaaacccacgtgggagaatgggagaaaatatttgcaaatcatatatctgaaaaaggactgatattctgaatatataaggaactcctataactgaacaacagaaaaacaaacaattcaaaaataggcaaaggactcgaatagacgtttttccaagaagacataggaatgaacaatatgaacatgataagatattcaacatcactaaccactagggaaatgtaaataaaaatcatgatgagataccacttcatatccaacatctgaaaatagcagatattggcaaggatgtgaagaaattggaactctatacattgcaggtgggaatgtaaaatggtagagatgctgtggaaaacagtatggcagctcctcaaaaaatacacgtgattcatgtgattcaacaattccacttctgggtatatacccaagagaaatgaaaatagaggctagaacagatagctgtttacccatatttgtagcagcattattcgtaatagccaaaagatagaaacaacccaaatgtccattggataaatcaaatatagtctgtaaatacagtggaatattattcagccttaaaaagtaatgaaatcctgatatatactacaacatgtgtgaactttgaaaacatcgttaaatgaaataagccagatacaaaaggacaaatatgattctgcttaattgaggtacctagaatagggaaattcatagagatagaaggtagaatggtgattatcagggattggaagaaggggagaatggagagttattgtttaatgggcatagagtctcagtctgagattatgaaaatacaggagacagaggaaccattttaaaaaaaatttttaaggtacattgtgaggaaacaatcagatgaatccagaaagtaaaacattccttaggaactggccattctcttcagtaagccagtgcaagaaaaaaggcagtaaattagattgaaaaagattgaaaggatattacagccagataaaatgtcttgtcccagattagatactactctggacaaagctgctgtaaaaggcatcatggagacaactgaggaaatttgaatatgaattaggaattcggggatataaagaaaatattattaatttttttcaggcattataagaatactttgcccatgtatgaaaatgttctctttttttagaaatgcaaactgtgtttagaggtgaaatgttcaaaatctctgtaatttactttaaaataatatacaaaaatattttaaaattgggatacaatgataaataatgttatgtcatctaattcctaattcatattcaaatttcctcaattgtctccatcataccttttatagtagttttgtccaaaccaatatctaatctgggacaagacattttatctagttgtaatatcctttaagtctgtttttgagttggtgcaaaagtaattgtggtttttgccattataaagaaactaaggggaattagataggaggtgaccagggattgagtactatagatttgcaatctctgagaaagtgacatttgagctgagatattaagtgattgccagctatgtcagttcaggtcctccaaggtctagatgacaagacaggattagttttaaaatagatcagaaaacacctgtgaaggatacaagcaagagaaggcaggagagtcttcaaaccacaatgcagttctggcacctgggaaaggagagcaggaaagaaagaggattggataggaagattttcaagagtgcagcacagttgtgagaaagtctcaggccaatgggagccccaaagtagaaactgcctatcagaggagtcctgccttgggcaagaatggcccagctgtggtgtccctactgaccatcccatcgatactgctcagtcgttggctggatgcagttagcctcagtatgaatgctgatgtgggtcacaagtcacggccactagagagtgctaactctgctcctcacagcaggttctcttgaagggaaatctgagcggcataccttcatagctatccttccagccttgcaaagatctggagggagagtctatcaagaggaggaaatggcaaaggcaaagtccctaaaatataggaaaattgttggtatatttgaggaaaagagaaaactgagtaagtttgcagcataatgagagtggcaaactggcacaagaagtcagattgataagcagagacgtcgtcatatggagctgaaaagactatgatgagggggtaaattttattccaagtataatggaaatccatcaaccagttgttttaagcagtgacttattatgatctgatttaggttttagattcaaacttcctaaaacattaatctgtatttatagcatccatttcttcatatttcattttctcccaacccacagcaagtttgatattcatcctcacctctctattgaaaatgcttttactaggttaccaaaagcttgttaattgctaagttcaattgcttctttctaattcccatcctagttgtctcctgggtcacatctacacttagccactcactccttaaaatttctctcatggctgcttttcactactcctttctaatttccttctatggctttttaaaatccattccctaaatttttttattctcaattatatctttaatactttcctgttatcccaaggcaccctcacctgctaaatttcacctacatgctgatgactccaaaatttcttttttttttttacctctagccctctattcacactcttcaaacctagattttcatatgtgagtcattcatttccacctcagagcataatataccaaaacaaaaatcattaccgtccttaagaatgcttcttatgtcctggtgcggtggcgcacatctataatcccagaattttgggaggctgaagtgggtggattgcttgagctcaggagtttgagaccagcctgggcaacagggcaaacaaaacgttgtctctacaaaaaaatacaaaaattagctgggcatggtggcacaggcctgtagtcccagctactcgggaggctgaggtgggagaatcacttgagcccgggaggtggaagttgcagtgagctatgatcatgccactgccctccagcctagatgacagagtgagaatttgtatcaaaaagaaaaaaagaaaattcttcttatatattctctttcttggataatgacatcaccagtcacgcagttcacataacttcttgaaataacatttacctcctcacttatggtcaaagtataattttcaaaatttaaagatatgactgtcgtataattatagaatgaataggtttcaaatgtctgtctctttaatgagataacaagcatgatggtaaagctggcttatagaaaaattagggaaacagtatacatagcgagtcacaaaagatacgtttaaagttataagctgaaataagtttgctaaattacaatgtcatacaagttaatgttctataggtcaaaataaactatagcctttggagttatgttctctgctagataaaaatgatttgcttctctatagggcaaaaatctacaagttaactttttacacagtattagttctaataaatggcatataaatcaaacaaaggtatatctcttggagaataaaataatcattgggtagatctattaagcaatgctccaggatgacacacagtcattctttggccttatttccaagttctggatattattttctcatacttgctgttgatcttaaatagccattatgtggtgatggagctatattttaaagacaaatctgcctgacttcaatgcctatgtttttcctcacaaagaatgtgagttgctggctaatgcaaatccatgcataagatgagatgtaaggactgagaagaggcctctgcttttcaaaatcagtaggacacagtgattaaaagagtacggcattagacaaagaaagaaaaatatatcaataggtagacctgcttatacagtccatatgatctactacaaaggcaccaatacaattcaatgggaaaaagaagacctttataataaatggtggggcagcaaccagatataacacacataaaaagacatgaaccttgattcctgccttgtaccatacacagaaatttacttgagattaatcatatacctatatgtaaaataaaaagctataaagattctgaaagaaagtataggggaatatctttatgactttggggcaggcaaaatttcttaaacagaacttaaatagccccaatcatgaaattaaaacttgaaaaattagacattaccaaaactaaacatttctgctcatcaaagacaccagtagaaaaatgaaaaggcaagtcacagactgggaggaaaaatttacaatacacatacctgacacagcattacaaatcaattataaaaagactaaacatccaataagaataatgaataaaagatttcaacggcacttcacaaatgtggctatctcaataaacacatgaaaaagtatttaacataattagttaaatacaagttaaaaccacaataaataatgtcatgcaggcaccaaaatggctaaaattaaatttaaaaaattttagatcaggagcaggttgctcatgcctgtaattccagcacttcaggaggccaaggcgggcggatcatttgaggtcaggagttcaaaaccagcctggccaacatggtgaaaccccaactctactaaaaataaaatttgccaggcgtggtggtgggtgcctgtaatcccatctactcgggaggctgaggcaggagaatcgcttgagcccaggaggcaaaggttgcagtgagttgagatagcgccactgcactccagcctgagtgacagagcgagactccatctcaaaaagaaaaaaaaaaaaaaatttaaagactaatgatatcaaatggtggcaagaatgtggatcagctctcaaaattgctggtatgagtacaaaatgatacaaccactttgtaaaattgtctgtctttctctactagtgttaaacattcacttaccttatgacacagcagtttcagttgtaggtatttactcaagagaagtgcatgtccccacaaaaaactttcacaagactgatcattgcagctttattcacaataaccccaaactgaaacaattcaaatgtccactaacaggcaaaagaacaaacaagttgtgatatattcctacaatggaatagtatcagtgataaaggaaaaaaataaaaatagaatacttctagtgtagtctacaaccaggttgcccctcctgcatattgttttgagtgaagtaagtcagatataaaagatatataaaagactacacacaatgaatatgtagtataggattccatttatagaaagttcaacaacaagcaaaagtaaacaatgtttatagaaatcagagtagggtttacctctggataggcagggatggaggttgtagtgataatatgttctgaaaagaaacacagttgagttttacggggttttggaaatgttttgtgtcttgatctgcatggtggttacctgggtgtatacatgtaaaaataatctaactgttcatttaagattagtgcacttcagcaaaggaaaatgtcagcagagtgaacagacaacctacagaatgggataaaaatttttcaactatgcatttgacagaagtctaatatctagcatccataaggaacttaaatttacaaaaaaaaacccattgaaagtggggcaaggacataaacagacaaaagatgacatatatgcggccaacaagcatatggagaaaaagctcaacatcactaatcattagagaaatgcaaatcaaaacaacaaagagctaccatatctcaccagtcagaatggctactattaaaaagtcaaaaaccagcagatgctgttgaggttgcagagaaaaaggaacgcttatacactgttagtaggagtgtaaattagttcaaccattgtggcagtgtggcaattcctcaaagacctaaaaacaaatattatatgacccagcaatcccaaggaatataaatcatactattatgaagacacatgcacacatatgtccattgcagcactattcacaatagcaaaggcatagaatcaacccaaatgcccatcgatggtagactagataaagaaaatgtggtacacacaccccatgaaatactatactatataccccatgaaatactatatacctcatgagatactacgcagctaagaaagaatgagatcatgtcctttgcagggacatgaatggagctggaggccattatccttagtgaactgacagaggaactgaaaaccaaaaaccaaatacatataagtgacatgtactcacttataagtaggagctacatgatgaaacacatggacacatagaggggaacaacactgaggcctgtcagagggtggaggttagaggagggagatgactggaaaaaatggctaatgggtactaggtttaatacctgggtgatgaaataatctatacaacaaacctccattacacaaatttacctatataataaacctgtacatataccccttaacttaaaataaaagttaaataaaaataaataaataaggtttagcacactttatgcattttactagatatgttatccatcaaaaagtcttagtttttcatggggccttgggttgcaagttttgtagaaccagagaaaatagtctagattataaaggatcgatgaataatgatgtaatgaaaattaacttcggtttcaagaaatttcacttgaagagaaaggagaaaattaaggaagtaataaaagacatcaacaagtcaaagaaaaatgttttcaaaattcctttagaattgggaatgactatgagggagaagaagccagtggagaagtgtaagttgaagatgggaacggagagaagagaaagttggtatctttgagttagaaatggaagagttacctaaaaaatgagaaggaagctatctaccttatcaactagagcaaaggaagagagtaggtgaagaaacatagagactatgcatctgacaaaggtctaatatccagcatctataaggaacttaaatttgcaagaaaaagacaaccccattaaaaagtgggcaaaggacatgaacagatgcttttcaaaagaagatatacttttcaaaagaagacacctttcaaaagaagacataatttagggacttttactgtacctggcctcaaccttcttactaaaatgggaagtaagaacatctactaaaattcaagaggtgtagggaaaagaggactggaggtagagagcttgatgaagtagctatgtcattatctgtgaaatcctaggcaagttactttgctttttgagtttcctgactcatatgatggaaataacattcacctcacagagttgctatgaagatgtaatgagctaatgtctacaaagtgtccgtataaggaaaacagtgaatattagttccccttttaaaggagcagagatgctgaaaattacccttcctgaatagtttggtgaaaacaacgaataacctggagtcagcctaaaaaagacccaacagagaaggatacagaatctagtgcaaagcacttccctaacatttgtgaaggacagtgcaaatgaaggccaaaataccttatgtctaaatatttaaaacttataaatcaagctagcaaagtattcagtaaaagatgttctgtcctcctcctttaataaatatagcttagaaatgacttgaagtccagtttcaaagttagaatctccagattccttggggtttcacactgagtcttggtgatgtgagaagagccagaacaactctgccttcttccgcctctgtcccacactgaaaggggtctccagtgtatgtgtgaggatactccagcctgagaatccaagctctgttctcaccgttggcatccttgggtcattcttcggcttagggttatacactcctatggcatggtctttgccttacaaaagccctagcagcaagctcagagccatttgggcagaaaattctgagggtccgagtacttggagctttctctggaaaggagcactgtgggctttgggttggtatatctcattaggccctggaggctcctcacctcatagtggagtggtgtggctgaagaagagccagtgtggctccaaagcatgggcccctgagcaggggcctctcatgcccagagccaagggctatgtagctagtcacgtttaagtctaagattactcacacttcgcgtcccaacagtaaatgcagggaaactccagtactactgactagaaagagcaaaagactcaagaccagaatatgctaaaaaatagaatgaaaatgaagtacaacctataaatctttattaagaagctcttttctacttaaaaagtaagcaatgtagccttctgagttattctgacgaattgaaaacttccctataaagtattgtgtaaaactgaaaatgatatcttaatctcagatatactctgcaaatcaggatactttatagctagcagtgacctgaaaatgctttgtgagccttggctggagaaaaagaaattttctaccctctattctttgtctggctttatatttcttaaaatcaagcaagttgtatttatatatgcatatttgtagattcataggatgtctgtgaactcaaatggtgttcttattacaacaatcagaaacaaagaattttgcattttttgacaaattctcattagtaaagaggcactaaacatgctagtgaatacaacatagaggagaatattcatcagattatttttagctaccacctacatacaccatcatggcaacatcaagagcaggagggaaataatgattcttttagtttaataaaccatgatgtttctgaaaatttcctctttcctttccaaatcagggcatctaattatataaattattactgtggcaacagattagataccagaagaaagagaaagagttgggggaagaatgaaggaaggaagggagggtgaaggagagaaagagaaggtgggagggagggaaaactaggctatgaaacaaacaagaaataatcattaaaagaagaaaaaaagtatttttactaagagtagaatgtgggaactggtaactagaagaaaaaggaaacactgaaaaaatgtatttaggattcaaaccagtcagtatcagaataaagtaaaggtaaactttgtgaatgttggtaaaagatgccacaaatcacagtagtaggttgcaaaagataggatgaggaaatatatacatatattttgaaactatgtaataaaccctgcaagtaagattcaatagaatataagatactgtgtaaataagaagatacaaagattacatattttttataacatatacattatatattgttacacataatatgtgtttatattacaactatttgagaagacagctcacataaaaagatatacaaatcctttttaaacatagagctcaaacaacatctctaaaaataagatgaaaacaaactactttgagataaaaatttttacccaatgaatttgcaaagacctaggtttggtaatacaaatttgctatgaaaagtgtagcaggacaaaactttcttaaatattgtaggtggttaaatcatttggggcaacttttttgtaaagccttggaaacagtatgtatcaaaatttaaaatgcacataccctttgaactagcatttatacttctcagaaattatcctttagatatacctgtacttgtacagacagtatgtacaaagctattcatgtagattataagaggaaaagattggaaaaagacttgaatgttcattaatataaggcaggttaaatatattcatttacattcatattgtgcaattattatgcacctggtaaaaggaataaggtaaatctgtaggcactaatatgcagtatgtttgaaatatatcattaagtgaaataaaaaaaagtgcagtgtatataacatactatcatttgagttagaaaacagtaataaaaaggggttggggcaacttcatattgtcaatgcttttcagccaaagatccccagaagtacttacagttaaacaagttgggtttaatattttgtgctgcaagggagaaagcagggaatttgtgtgatatctcagcgaaaatatgtaaaaagaacataataaggatttggctttggtttgggtttatggaagtaagggcaatttcatgattgaatatcttaaattttatctacagggaggaaagactataggaggacaaagctataattgggtaaagttaaaatctccccacttggccttcactggtatgagtgaggatggggccatagttttggtgtttggcagcagtaagtttgttatttttctatgaagttttctgtcttgctagactgcctttatcctggtcctttgactcgacggagccgacttttgctgggacattttttttgtctgtgcccattggcatttccaggttgccagctttgcaattaccatctgtgacatgtaaagggaaaacaaagagtaaggaactcactgtcatgtcattcttcagatcctgaagttctctcacctcttttgccttctctttactaatcagaatcttcatatgtttgttttatatattatgcccagggtttttttgtagtaccgggaaaagtatatctattgcatcttcctggaaatggaagtcctcctggatatacttttgtttggtttgaattttttgtcataagcatgaatgccatagattattacatgcttttctaggactgataattgttcaatcttaatgaagagaataatggaataaagttggggtaagtaaagctgcttaattcagttgatcaggaaaggcccctctacaatacttgagctgagatcagaatctaggcttgtgaagaactgaagagcagaggaagggtaaaagcaaaagtcctgaagtaagaacaagcaaagcacaatccaggacagagtgctagtgtcagtgaaatgctggagctaacttgtgtcagctcagaagagccaattgttaaaacttcaggaattttgtgagctggtacacaattattattaaaaattaaattatataaacttataattaaatatttgaaactcaaaagcaataaataatcaaaaatttaccatttttgaattattttacattttcttattatctatgtttttgaaattatttatacctaatacacacacacattgtggaaatactatataataccgcactgctctgcatcttcagtgaccttatattgatgtatttaagttagtgagagtatttacacctcagatactggcaaatgctacaaatcagggcttaatttgttgtttttccaactgtctagatttaagaacatgatgaagaaaatgttaacaatacagattaaacttaaaagtatgtgaagttagtaaccattacattatgcatagcatgaataaataaggaaatagccttccagtatttaaaaactatcatttgattcagccaagaagtcactcagatcatcgataaaggcattaaatttcaacatatgtcttcattgttttacttttatcttacttatggaggaaggagaaagaggggagcaggaaagaatagcacttgtaaaaataaagcaaaaatttatagacattatcactgcttgccttatttattgtatctctgtcagatggccatctgtaactgtaagggagtctttgaacatgcattttaaacattgctgcctctaactaaataatgattctgttaataaggaaggagaagaaagtagttggctagaaaagtagacaaggcagatgaggcaagaatggaagcacagaaaccagtagaggctattctagtggcccagaatacagaagatgtaggcttatactaaggcgggggtcatgggaatggagaagactgaacagattcgaagtagtatttggagactgaatgaataaaacaagattggaggaggctggggaaggaagaattaataactttcttaggtttggggttagagcaactaggtggatggtggtgccatttacagagatgaaaaagactggaaggaaagtatgggtgcagaaatggggaatttgtttgaacttagagacagcaactttcagatgccttttaaaaatctatgtggggccggacaccgtggctcacgcctgtaatcctagcactttgggaggccaaggtgggtgaatcacctgaggtcaagagtttgagagcacctggccaatacggcaaaaccccgtctctactaaaaatacaaaaattagcaggcatggtggcgggtgcctataatcccagctactcgggaggctgaggcaggagaatcacttgaaccctgggggtggaggctgcactgagccgagatagcaccacttcgctccagcctgggcgaaagtgtgaaactccgtctcaaaaataaataaataaatatatacataaataaataaatacgtggaactgttaagtaggaagttatttataagagtctagagcttcagagaaaagtgaaatctaggaataaatttgaatcatcaatatttaaataatatttaaagtaacgtaactagacaaaatcaactaggaaaagtgtgtctgttatatatatgtttatatatatgtctatatatgtatgtgtgtgtgtatatatatatatatatatatatatatagttcaaaaccaaagctagcatattgtaagaggtatgaccaatgtagtagaaagaaaaccaggagaaaaaaagaaaatatatatgatgtatacacacacacacacgcatatatatatgtatatatatgtgtatatatgtgtatatatgtatatatatatgtgtatatatgtatatatgtgtatatatgtatatatgtgtgtatatatgtatatatgtgtgtgtatatatatgtgtgtgtatatatgtgtgtatatatgtatatatgtgtatatatgtatatatgtgtatatatatttgtatatatgtatatatgtgtatatatgtgtatatatatgtgtatatatgtgtgtatatatatgtgtatatatatgtgtatatatatatagagagagagagagagagagagttcaagaccaaagctagcagtttgttaagtggtatgatcaatgtagaagaaaaaaaaaaaaacaggagaaaaccggtcatgctgaaaaccatataggagaaactggtcaactcagctgggcttgacaaaattggtaacctcagcaaaagcacattttgtgaaatgttggtattggcagccagaatgaattaattaaaaatagtcacagcatttctattatcaaccaagacttatgcaaaacgtattctaaaatttttttctaattgtgagaactctaaggtggaaaccattttaaaactcacaagtttacctggcaattggagactgaattccttcctttaaactgacgctattatgagtctatcccttgctgattgcccctttccccatttattatttatagcaaagcttgcatacttatggcctgatggccagaatgtgcccacatattttgttcaagctgtgtagtactggcttatgcagaatttttaaatttttaaatcttggaaagaaaagaaccctcatctttgtaggatacatattactagtcagtctctcctgcttgccctctacctccccatcatcattaataatctttccacagcattattttctttctcacacattccttaaaaagctgtttaactattgaagtatttacaagtgagatgatgtgatgtctttagcaggcttcaaaataatgcagtgtcagggggaattggttagtgagggtgtagatgaaaccaaatcggccatgcattgaaaattgttcaggggccaggcatggtggctcatgcctgtaatcccagcactttgggaggccgaggcgggtagatcacctgaggtcaggagttcaagaacagcctgactgacatggtgaaaccccatctctactaaaaatacaaaaattaactgggcgtggtggtagacacctgtagtcccacctactggggaggccgaagcaggagaattgcttgaaccctggaggcgaaggttgcagtgagctgagatcaagccgttgcagtccagcctgggcaacaagagtgaaactctgtctcaaaaagaaaaaaaaagaaaagaaagaaaattgttgaggatgggtcagtatgcaagggttgattatactgttctctctacattgtacgtgattgaaaatttccagcataaaaccgttttttaaatgggggaggggaagaactcgagtaatctttactatcaagaaatttatactcaacttgagacggcacattactcaagaagttaaaactcggaggctgaggggagaagagtgtgcactggcagaaggagagatggcacaaaggtatttaaaggtatgccatgttgatacagaaggccagattgcagtatggttgcagcagagcaggaacaaacattcgtggagtactttgtgttaacttctatgtactgtgttttacaggatttttctcatttactgttcacatacatcctatgaggttgatatcataggcaagaaagctctgatactcaaacaagttaaattatctgccttgggtcacaaagctggtgtaggataacttttggaaaagcaatctcactggaaaagccagactgcaatttgctgaggaaaacttgtggaccagagaccaggggtcacctacaagctaaataaaatgtatggaaagtatgcttaaaatgtttcattttgttgctaacatttaaaaatcaggaacaaagactttagatttctgacttttctttaagaactgagaatctatccacatgggtgctgtaccacctcacagccaaggcactgctgccccctttaggtgggacttacgctctcctttctgtgggagttcctccactcattattgcaaatgtactgcttcactttacgcattacggcctacataggtatttgaattcatttatatactaattgtattcatcctggagtgttatgacatggtggcatgggtgtgatcagtgagagagaaaggagtacagtcttagaaactcaatgtgatttgaccaccacatgttgagaactacgctccaaaccacttctctggcaattaatcctgtactccatgcctactataatgtctcttgcagagttttcttgtgctataaatgctaagtgccatatgataagtggtgtgataataaacgcttagggtttcagaggagggcacaattatttctgcaatcattaagacaaaaaattataaaagttgaattgaaattttataagagaagacaaaccattacatatggaaggaaaatcacaggaaaaagcataaacttaggaaggtgcaaatatgtgcagagagtgggaagtggaccagtgtactcgaagctgaggttccttcatctaggcaactgtaactcagggcttgatagaaccacagaaatgtttaaactagaaaagaacttacttgaaattattctttcagaccatccatacttgaaattattctttcagatgacaaccaagatctttttttacaattttttgtagaggtggggtctttctatgttgcccaggctagtcttgaacccctggccttaagtgatcctcctgcctcggcctctctaagtgttcatattataggcataaactactctgcccaggcacgatctttagaagttaggtgatttgcttaatgtcacatcgctagttcatgaaggaattgacattaaatcttccgctttccatggttctcctctgtacttcccttcaacatgaatcatttacattgtagacaaggagagaaaagtctgagctgctgctgggttctggacacattatttttcttgacctcaagtagcaattgcccttttcctttcatcattcaatttcacttcaaattcttaaccaggaactgaaccaagaaagtactgcaggcaaatctgacaagtagaaaaaagaattaagaatggttgatgcatcataccactttttgccattatgtgactacatctgaccttcttcaaaaatgacctggccagcttctaaattctatattactaccaggctcagaaaaggggaagaaactacacagtgaatttttaaccaactaaagtgggcatgaggaaagggaagatgtgctggcagacgagtctcaggctcagcatttgtaataataagaattgaaatctgaaaagagtagtcagtttcagtgctgcctaaaaggcactgaagcaggcttcctctggctttcaatccacagctagtgatgcctagtttgcatcttggaattcaggactggcaatatagcctagtgttaagatcacagcctttggatttgaatccaggttttagcatttaccagctaagtgatagggataattgatttaacctctccaagcataagtttacacacatataaaatggtgacaggaatagttcttaccatcctcattgggttgcaatgagcatcgagtaccttaatttaggtttccccaaaagcacaatctgagatgaaaatttgagtgcaagtagtttatttgggaggtgagagtgtgatgatgtgagacaaggagaaaagccaataatggctcagttaacaagcacataccccctgggtgaagaagaggccaaatcctaccagggattcttcatcacagggctaggaagctgggaagggtagttatccttaacttcccattcctcgctggttgagaatttctcctgggcaagcgtcccagacacttctggcctcccctgagcacaggtcaggtatagtccagaacacagagaaagccctctcacagaaaatccatgacttgaagtagaaagctttgtttttataggaaccatccactaaggctgcaggtgactcctagatggggccaaggggatatggatagggcattgacagcatcttctatagtgagataatgtatttatcatagtaatgcctggaacatagtaagcactcaacaaatgatacagctacttaaagtacaaagtgcttggcacaaagatggcaaagggaaggtcttcccaattaaaaagaggaaacactatcactaaagagatgagatgagtagaatcaacccagaaacctgggagtcatccttcactctaccttcttctcttcaccccgctacccaaccgaccccacctttttctccatgtatcatcagtttaatcactttagcatctctcctttctctcttctccactccagcaacactaccttaaggtaggctttcacattccttgctttaagtatcatatcaactttctacctgcctgaccttcctgttactctccctttcttgaatcacccaacccattcattcagtagtatcagaatgcttttttctaaaacccaattctgacaaggtcaaactctacctcaaatacttcaatgattcaccatttatttctgggtaaagttaaaactctttaggacacaagactcctcataacctggtcctgcttatttacccatcctatctgcactgtactttaccttcaacttccacacccagacataagatttagtgcctaatgtatggtacattttctcatcattcactgccattgcctgactcccaccttttttcatctagaaagctcctagttttcattaaggaattcaaattgttatcatcttctacaaaaaacgatccctgatatttccccttccctcttgatctggataggcgatcaaatgaccatctttgtatatctttttttttttttttttttgacagtgtctcactctgtcactcgggctagagtttagtgacaccatcatggctcactgcaacctctacctcccaggctcaagtgatccctctgcctcagctaccagaatagctgggactacaggcatgcaacaccacactcggctaatttttgtatttttttgtagagatggagttttgtcatgttgcccatgctgatctcgaactcctgggttcaagtgatcctcccacctctgccttgcaaagtgctgggattacaggtgtgagccaccatgcctagcttgtatatctcaaaacctaccacttgtattatcagtattggcttactttatgtcttactaattaaactatcattcttcataattagataccaagagtctgcattcataaaaagtatgcaaagtgatttttatccacactgaagtctaaaaacagttttttacaataagtgcttcctaaagggaaggaccttttctccttgtaattccagtgcctaacatagctcctagcatgtacctgatactcaataaataacacttgaattaataaatgaaattacttgtctggaatatttccactctttcacagagattttatcaggttgccacatgtggtaataagacttattaaagaatgcttccctgcacagatggtattgtaatttgggtatctcattgttgatctgccagtcctccagctaagtggttattaaataagacctgttgttctactttttcacccttgattgccttaaaatcttttttaagtatttagtcttattggttttggtaatgaagtctagaagagtggttcttagacacatcagaatgacctggagagcttgctagaaatagagatgtttgaaccccaatcccaaagattcaaattcattatttgagtgggaaggagccatgctctgtatttttaatgagattttgaagaagaaagtatcccctgtaataaacacaactatagattgtataatttagagaaaaggatggcatttttacaaacagatacacctacacccttatgacttatttcctctagacaaataccatgacctgtttcaaaagaggttatcagcacactttacaaatagctcttgaagtttggcagcgttacaatattttgccttgattggcttgcctagtaacttaacatacctaaagaaaaatccactgtctttttttttccttcctcttgtgaatataaaggtagactgcatatttaaccaagaaattgggagtatggtcatccaactttgacttgtgtgagctcacatgttgcatgttgccttcttactagatgacaaaatcaaatcttactccagacctcgagtctgttcttactttccacagcaggctctgtagttacctgaaccctgacaacaatggagggggctgcagggtgaggacaagtatacaccttcctccctttaccataaactatccagggtgtcatggcagtctttggcccagactgttttcagaataaagggttttattattttacacgggaatcataaagtgagcctctttgttcctctgtttagttcatctcccctttaaacttgtatatctactctagaagactactagaaagtctagattactctagaaaagacttggcatcttgtttgtctcatgctggatatattccactatggtactctctagaccaaggatgagaattaaactctattctgtttaattccgtttaagctattatagtctccaaagtgaaaaaaattgctttaaaagtggtatcagaatactcaggaattgaaaaaaaaatagttttctcttgacaatacttgagctaatggtgatctgaaatgtccaaggagaacctgggaaaatatttttcatggtcagatggagtccagacatctatgggagctcttgtctctcatgccgttattagaaataaaatcgttctatagaatagagtgattccattttacttagtactgcaaaaacttatacccatgcagaaagtaaatgatacctgtgaattttctgagtttacctataaataaaatgtttctggacttccagatgtaatttttataagtataaatgtcaaaggtttttagattggatagtgttatagaaatacattttaaattttataataaaagtcaatgataaattaatatttaataaaatatacttttgtagccaattttgctataatagtgtatttaacaaaagcaagggactgtatgtagttttagactatattttagaaaacattgttatataactgtatataacatatacctatttattttataaagttccctttaaaattttgttagaactattaatttcaccattaatttaattttattatttggttttggctgtctaatatctggcaatttcttcagtgtaacatcatctttcattaattttttttcaattatgaggtttttgtgtgttttaattcaaatcctacttaatagagaatataacttgaaaagaaagagctaagtggccaagtctgaatccttaatttgaaaaagtgtattaagaattgctttctacaaacaaatgtttttatattcagggccacacgaaaatattaatgtgaaacttcatggaaaaacttgctttactgaatttcttgagttaaaccactagatggcaatagctttgtttctttgtgaatgaactagacaaatggctcttaaagaaaacatttgttttcttgaaagctcttatctcagctaccaaattgcaattcctcaattcttaaaaaagaaaaggagaatggcgtgaacccgggacgcggaggttgcagtgagccaagatcgcagccactgcactccagcctgggcgacagagcgagactctctctcaaaaaaaaaaaaaaaaaaaaaaaagaaagtcactgggtcaccgaggtggaaaaagaatggcttcactttggagcccgcaaacttccaagattttaggcctgtaaagatacttcatacaggaagacacaggtgaaccagggctcatgaatctgtcttcatttctttccactaatttttttcctttctcatctaatttcactttctctaaaacttatttttgctgtttgtggataaaaaaacacagccaagggtagaaggaaggaaggtttgcagagcagataacacttctgatggattttctctaccacagaagattttacacactgcatggaaaaactatagtcactgtacccaaaatgcattttctacctcagaattactaccaagtttttatggttcccataccatgtgatatattatatccagctagctttactcattttacttatctgctttcgtcttcaaagcatttgagtttgcaaactttgaccttttcacagttcgcaagatgtactgtgttctcttatttccaaatctagtctctggagaaagtgggacacatttccagatttgagaatattgagtggcaccacatcccatttagaatagtgatccaagtcagagataatttattcaacctcccaaacaggcaactatgtgtcttccttgccctcacaaaaatctgcctaaggacgttttctagaaaccctcttccatttaaagtcagttgaaggggaaagttctgagaagtaagagtgtaattggagaagtggcaagaattgagcagcagtaatgggcaggcaaacagtaagaatatataggctatagagagaatatagctatgagccaactgggaaccaccacaaacggtgggtcctttgggagttgggaattctcatgacttaggaaaaacttgagtattaaagagtatcaattatcaattttatcatttgtttactgacactcaaaaaaattgagtatcagtttcatcatttgttattctcatcctccactccaatgctgtcagtgctgagctcacttaagggaaccaataaatatttgctaattgggttctcattcttatagtaggtcaacgattaatataacaactttaattttctgtcaactgttttataactcagacattgtacatgtgtgtgtatgtgtgtgtgtgtcttaatttcgtaaaatcagtggagaagtaaaggtgtgattgaattattaatggtaaaattccagaatggaactgggaatatattatcaccacagcctgctttactcctttactacctaaggatttcacaaaactttggataatagaaagtgtattttcactggtcacagtttctgtaaagatgtatactaaagtctctcccactatcactgtctattaggccacttggagaaccctgacctaaactgaaccaatcagattctttttcttgagatgctgaacatggacattgagccgacgagtcagacaatgctaagtacttgaactgaaagctcagggcaagacctgacaaaggacagcaaaccaaagccaagtccaagataatttatgggggcaaagagatgcccagaagtacagagagaatcagggccgtgccactcggagagagatgaaaggaagtattgaggttttaaaactttttttttcattttccaggtggaccaactatattttatttcttcggatgcttttgaagtgaccagttttgtcctcttgataaacttgtcctttattagtgctgatttgtgtatatttgctacttacaatcacgcaatggataatccctgtctgctacctgcagcactgccagatgcaggaaacttctttggcagaatggagagacctcatttttgtgacctgagaacatgctgtggtctctatggtgatttttacagctgattctcagtgctttgtaccatcatgatgctgaaggttaaattaaaatgttgctaaaaaaacagatgaagtggaaccttagggtcaagttgagtcttccttggcatttctgatgtaattctctccacatcatatattttcattaaaaatatcaaagttgtggtggctcctaggcctacatttaaaggttacaggctgggcacagtggctcatgcctgtaatcctggcactttgggaggccgaggcaggcggatcacctgaggtcagaagtttgagaccagcctggccaacatgttgaaaccctatctctactaaaaatacaaaaattagctgggcatggtggcaggtgcctgtaatcccagctactcgggaggctgaggcaggagaattgcttgaacccgggaggtggaggttgcagtgagctgagatcatgtcattgcactctagcctaggcagcaaaaccaaaactttgtctcaaaaaaaaaaaagttacaatttttgcatttttagctataagaaatagtatcattttaatatttaaaaactatctcattgtattatctatttaatggtcagatttttttaaagcttcaaataagataactaggtcaatggaaacaatttacctcaatataaatgtgtttttctttgattctttcatcaatgattcagttaccttttttcttttcaccattttgtatttattataaatgaataagaatttaaattaattatagaagatgcatatataagtataaaatatagtttttatttttaaaaaatcatcttttttgccacaatcttctactggcaagtagctttataatcatatctaattatatcaactacatgaacaattatgttacagatcattaaatttcattatattttgctatgaacttagagtacaacaataagaacaaatagactcctcaacttctctacctctaataacaagtttcctttcacattagtttttatcatcagtaaataaatatataaattttttttattattactgttattattattattattttaattatactttaagttttagggtacatgtgcacattgtgcaggttagttacatatgtatacatgtgccatgctggtgcgctgcacccactaactcgtcatctagcattaggtatatctcccaatgctatccctcccccctccccactccccaccacagtccccagagtgtgatattccccttcctgtgtccatgtgatctcattgttcaattcccacctatgagtgagaatatgtggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgacggccagtgatgatgagcattttttcatgtgttttttggctgcataaatgtcttcttttgagaagtgtctgtttatgtccctcgcccactttttgatggggttgtttgtttttttcttgtaaatttgtttgagttcattgtagattctggatattagccctttgtcagatgagtaggaaataaaagaggatacaaacaaatggaagaacattccatgctcatgggtaggaagaatcaatatcgtgaaaatggccatactgcccaaggtaatctacagattcaatgccatccccatcaagctaccaaagactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcacggtactggtaccaaaacagagatatagatcaatggaacagaacagagccctcagaaataacgccgcgtacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaaccaaagccaaaattgacaaatgggatctaattaaactaaagagcttctgcacagcaaaagaaactaccatcagagtgaacaggcaacctacaacatgggagaaaatttttgcaacctactcatatataaaagtatactgagctgaggaatatctgttaaaactggtatttgagggaaattattcaaattgtagtgttcaggattggagagatggagagagaggagtcagagagagagagagagaaaggatatgaagcatagtaggaggtttctatagtaatccatgtgtgagctgatagaatcctgaaatagactgaaggtagagtgatgcaaagtaacagacaagcttgacagacatcggaaagatgatgacatttttaataggaaagagacaggataactgagcattcagctctggatacctatcagaaaagtagggaaatcaagaaagttatactatagactgaatgtctgagtcccctccaaaattcttatgttgaaatctaacctccagtgtgatggtatttaaagatgaggcctttgcatagtgattaggtaatgagagtggagccctcatgagtgggattagtgattttctacaagggacaccagagagctctttctctcccttcgtcatgtgaggttacagtgagaagatggcagtctgtaaactaggaaataagctttcaccagacaccaaatctgttggcaccttgattggattttcctaccacacgatttcattgttggtttgccctcctctcccctcccctcccctccactcccctcccctccccttccttcccctcgcctccccttccttcttctttcttcagatgctcttgaaatgaccaggttttgtttttttttttctcactctgttgcccaggctggagtgcaatggtgccatcttggctcattgcaacctccgcctcctggctcaagggatgctcccatgtcagcctcccaagtagttgggagtacaggcatgcgccaccacacctggctaatttttttttttttttttttttttttttgtagaggcaggttttcaccatgttgcccaggctagtctcaaactcctgagctcaggtgatctgccggtttcagcctcccaaaatgctgggattctaggtgtgacccaccatgcccagcctcattgctgatttctaccaaacatttaaagaagaattaataccagtccttctcaaattcttccaaaaagttgaaaaggaagaaactggaagaggagggaccaaaatttttagccagagcaattaggcaagaaaaagaagtcatccaaataggaaaggaaaaaggaaaattgtctctctttgcagatgacacaatcttatatatagaaaactcaaaagactccactgaaaaaccaaactaataaacaaattcagtaaagttgcaggatacaaaatcaacatacaaaaatcagttgcattgctattcactaacaatgaactatcaaaaaagaaattaagaaaagaatcccatgtgcaatagcattaaaagtaaaatacttaggattaaatttaaccaaggaggtgaaaaatctgtaaattgaaaactatgaaatattaaataaattgaagaagacatcaataaataaaaagatattcagcctcaatagattggaaaaatcaacattgtaaaaatgtccatactacccaaagtaatatacagattcagtgcaatctctatcaaaattccaatggtacttttcacagaaacagaaaaaataatcccaaaattcatatggaaccacaaaaaaaccctgagttgctaaagcaatcctgagcaagaacacaacttcctgatttcagattatattagaaagctctagcaaacaaaacagtattgcactggcattaaaacagattcacagaccactggcacaaaagaaacccatgcatatacggtaactaatctttgcacaggcttcaaaaatacattatgggaaaaaaataatctcttcagcaaatggtcttgagaaaactgggtatctacatgcagaaaattaaattagattctaattttttttttcttttttgagatggagtctcgcgctctcacccaggctggagcgcagtggcgtgatcttggctcactgcaacctccacctcacaggttcaagcaattctactgtctctggctccccagaagctgggattacaggcgcccgccaccgtatacggctaattttttgtatctgtactagagatcgggtttcaccatattggtcaggctggtagagatgggggtttcactgtgttagccaggatggtctcgatctcctgaccttgtgatctgcccacctcggcctcccaaagttgtgggattacaggcatgagccaccgcgcccggccactatcttttttatatgctcaattttctatgcatttatcactacttcatcatccaaatattctccaggtatgtaaatctcttcttaatatggttaaataaatatcttaagtagtattctaatagtttcatcatcttgaagaagtttctcctagagccatttgatctgctccagtacaactgggctggtttctagattcctgtggtttgagaagctctttcaacattatattggcaatgcctttgtcttgcttttgtgttgaaaccatgtgccttaaatcatatttcttcacattttaaagtttactctgttgtttcagtagaaggcattccagtatataaaagtttttgttctaccctcacacttgactgatagtttggctgggtatatagttcaaagttgaaaagcatttgcctcaaaacttttttttttttttttgagagggagtctcactctgttgcccaggctggagtgcagtggtgcaatctcggctcactgcaagctccacctcccaggttcacaccattctcctgcctcagcctcccgagtagctgggactacaggcacctgccaccatgcctggctaattttttgtattttttttttagtagagaccgggtttcactgtattagccaggatggtctagatctcctgacctcgtgatctgcccaccttggcctcccagagtgctgggattacaggcgtgagccaccacacctggcctcaaatttttaataaataattcctccattgtcttctagcatccagggtaacttttgaggactctaaagtcattctaattctttatcttttaaataaagtctaactctacccccattcctggcaccccccccccacaaaaactggaagcttgttgagtcttttgtctgtatctagtgttcttaaatttcatggcttgtatcttggtgtgtatccatcttcattttgtaggcagtcctttcagtctagaaattcatattttgtactctcataaatgcttctgaataatttcactgataatattttcccctttgttttctcttttcttgctttttaggatacttactatttgaatcttgggcctcctggactgatactctgatttacttatcacctccgtcctattttccattccttggtttactttctagaaagtttttttcaaccatattgtccaaaatatctataaagtttctactatcatcttttttaagagttattttttctttttgttgcttatttatacaccattctgttcttttatggatgccaacttttgtcttacctttgaggagattaataatatatttattaaagtattcctttctttaaaaatttaaatctatacaaaagtagaatagtataatgagcccacatggatctatcattcagcttcaacaattatcaactcacaattttgttttttctatactcccaatgctttcccaactctcctcccactttgaatagttctgaagtaaatcccagaccacacattacattattgtttttggtatggttgtctaaaaaatgcatgctgtatatttttatataaccacaatatctttatcttgccttaaaaattaacaagaattccttttaatcttcatcaaaataatactctattaaaacatcaaatactaataacaatggcaaaaatcaaaaaccagcaactctttgccttattcctgcccacctataaatcttactttccagaggaaactagtttagagtccttaagacattttaagatatttacttatcttgcaatttatggtttatgtttttacaggttacgtgttgatatactattgtaatagatgtaaatttagcactcatctgacaacgcttcctactatcttccccagagttacataaaaatttctggttatatcagtgtttgatatatgcttttttgctatttacattttttaaaacttgttattattgaaaatttcaaatatatgtaagagaatgtaatgtaataaatcccatgtatctatcatccagtttaatatttacaactgcatagctagtttgtttcatctttgttacatctttttttttttttttttcctgaaacaggggactcactctggagtgagtgctggattgcagtggcacaatcacagctcactgcagcctcaacctctagcctactaagtagctaggaccacgggtatgtgtcattatgcccagctaattttttttttttttttttttgtagagatgaggtcttgctatgttgcccagctggtgttgaactcctgggctcaaactatcctccagctttggcctcccaaagtgctgggattacaggcatgagccacggagccagcctgttatacccacattttgtagcaaatctgagagagatatcctttcatttgtaaacaatttaatatgtatctccaaaataactttttttcaaaactgtaatggtttaaccatgactaaaaaaaacacacaaaaaaatacatttgtgatagtctcaaatgatcaagtcagcatttgcatttctccacgttttattttttctttttcctctgcctcctcctcttcttcttttgttgttatactggtttgtttgaatcaggatctaaatactatccaaacctgcaaattttgcattccatttaaatgttttttaagcctttaaaactacatgggttcctttttcctctgtccttcttgtcctctagtttatttgttgaagaaaccattatgtttatcttacagttttccacattatgaactttgctgattacattttgatgatgccatttaacatgttactctatgctttatgttttctataaactggcatttaagtgtctagacaatctaggtattaaccttttgtggcataagctgaaaataatcttttccagtttgttacttatatttttgctttgtttatggtctttttgtcatgcaaaattaaaaaatatttttaatgtatgcaagtgtattaatttcttattttattgctagtatttggaataagatcagaaaaatttttcatatccacaagttatacaggagtttgcttctgttttttttttgaaacatatatggttttattattttacatttaaatctcttgagaagaatgaatctgattttatctttttccatttcactgctatcccaagagcacgtactgaaaaatttatgttttcctttgctaatttaaagtactacctttattgtacactaatcaatataataattgtatctatttataaatttttacattttgtttgatcaattctgttcatgcgacaataccataatgttttaattttacagaatttgtaatatgataagacaggaccccttatatttattcttccttagcatggtctttctagctattgtgtttgtttgtttttttgagacggagtttcgctcttgttgcccaggctggagtgcaatggcgcgatcttggctcaccacaacctccgcctcacgggttcaagtgattctcctgtcgcagcctcccgagtagctgagactacaggcacacgctgccacacccagctaatttttgtatttttagtagagacagagtttcgccacgttgctcaggctggtctcgaactcgtgacctcaggtgctccacccgccttggcctcccaaagtgctgggattacaagtgtgagccaccgtgcccggcctgtttttgttttgtttttttttttgagacggagtctcactctgtcgtccaggctggagtgcagtggcgccatcttggctcactgcaaacctccgcctcccggggtcaagcgattcttttgtctcagcctctcaagtagttgggattacaggtgcgtgcccccacgccccgctaatttttgtatttttggtagagacggggtttcatcatgttggccaggctggcctcgaactccagacctcaagtgatccactggccttggcctcccaaagtgctgggattacaggcgtgagccactgcaggcccggccatttttctggctatttttgcttgtttgtttttcctaatgatctttatcattaacttgttaaggtctagaaaaaaaaaaggtagcaattttatggtatcatattaaattcataaagtgacttaaaagattgatatctttataatacagaattatccttgtctaaaactatgaagagtacaaaattttgccctacttacaagttaactagtaagcctaccacagtttatggatgctggtcgaaaacaagaaatgtctgggtcggagacaaaggatttcattacagcagttagtagctagggtattagaatgttcttgcactggtttcctgaattccaatggccacaaggtgatgtgaagagggcaaggtgacactggcacatgtagggagttgctaaaaaggaaaaaatatatatatataagcttaggaaacccagtgtttttatattggacgttaagaaaatacaccctttgctctggagggagacaccatctctatttttgaaaactattcactatacagccatctttgaaaatatgaatttttttccattcttattttagagacagagtcacactatgttgcccagactgaccttgaattcctgggctaaagggatcctcctcccctcaacctcctaagtagctgggacttcaagtgcttaccaccatgcctagctaaaaaagtgattaaaaaaatttttttaggctgggcgcagtggcttatgcctataatcccagcactttgggaggccaaggcaggcaggggtttcggaggccaagcctgagctcaggggtttgagaccaccctgggcaacatggtgaaatcctgtgtctactaaaatacaaaaaattagccgtgtgtggtggcacgtacctgtaatcccagctactcaggaggctgaggcatgagaattgcttgagccccggaggtggaggttgcagtgagccaagatcacaccactgcactccagcttgggcgaaagagtgagactccgtctaaaaaaaaaatttttttttgagatagggtctcattctgtcacccaagctggagtgcagtggtgtaatcacagctcactgaagcctcaacctcccccaccctagatgattctcccacctcagcctcccaagtagctggcactgcaggcatgtgccaccacacccagctaatttttttgtagagatggggtttcaccatgtgcccaggttggtctcaaacttcagagctcaagcaatccacctaccttgacctcccaaagtgctaggattacaggcatgagccacaatgcccagccataaaaaaactgatttttgactagggtataaagacaataatgagaaagaacactttcaaacaaatggagattggacaactggatatactcttgcaaaagaaggaagtcaaaccccctacctcacatcatatacaaaaaaataacccaaaatggatcaaaaaactaaatgtaatggctgaaaccataaaccttgcaaaagaaaacataggcatgaatcttcatgactttggattagacaacactttcttagctatgttatgaaaagcacaagtagccccccaaaatctagataaatttgacttcatccaaattaaaaacttctgtgtttcaaaggacactaccaagaaagtgaaaagataatctgtacaatgagagaaaatattttaaatccatatatttgtaaagagctagtatgcaggatatgcaagaatctcttaaatgcaaccaaagataatcctattaaaattaaaatgggcaaaagatttgactagttgttccttcaaagggaatatacaaatggccaatgagcatataaaaatgctcgacatttttagccaataggaaaaggcaaatcaaaactacaatcaaaatctcatgctcaataacatggtgtctttatttttgttgttgtaacatagtacctaagactaggtaatttataatgcacagaaagttattcactaacagttctggaggctaagagtccaaggtcaaggggctagcatttgacaagggtcttcttgctgcatcacctcatggtggaaggtggaaggccaagacggagtcagagaggggtgaaccctcccttttatataggcaccaatcctccccgtaagagttaagctctcattgcctaatcacttcctaaagatcccacctcttttttttttttttttttttttgagacttcttattctcttgttgcccaagttggagtgcaatggcaccatccggcccaatctcggctcactgcaacctccatttcccgggttcaagcaattctcctgcctcagcctcccgagtagctgggactacaggggcacgccacaacgcccaactaatttttgtatttttagtagagacggggtttcaccatgttgcccaggctggtctcaaactcctgatctcaggtgatctgcctacctcggcttctcaaagtgctgggattacaggtgcgagacaccttgcctggacaagtcccacctcttaatactgttaccatggcaattaaatttcaacatgagttttagagtggacaaatattcacatcatagcagatagtataataaaaaagatgcaaaataatgagtgctggtgaggctatggagaaattgtaaccatcatacattgctggtggggaatataaaatgggacagccactttgcaaaagagttcggcaattcttcaaaaaatgaaatgttagagctactatgacccaacagctccacgtccaggtatagaactaagagaattgaaaatatatgaatacacaaaaattattcttgaatgttcataacagcattattcataatagtcaaaaagtagaaacaactgaaatgtccattaattgatgaatggatattcaaaatgtggtatattacacaaggaaatattcatcaacaaaaagaactactgatacatgctacgacatggatgaatcttgaaaacattatgctaagtaaaagaatctaaactcacaagaccatataattccatttatctggaattcccagcataggcaaatccctagagacaaaaagtaggcgtggtttccaggaactgagggtaaaggagaattggtagtgattactaataggtacagggtttctttgagggcaataaaaatgttctggaattaggtaatggtgttggttgcacacatctgtgaatatacttaaaaccaccaaattgtactctttaacggatgaatttaatggtgtgagaattatgcttttataattttaaaaaatttaacatatggaacaaaagtagtcagtgcttgtttgcaagatgcacagaaatgtgagagaccccatggagaattgtttctcaatattcctatccaaatattaatacatagtatttgttgtttttcttaacatagttttctgtaaataatgttgaacattttttatttgtgcctaggtatttgaaaaattattataagtatatgctttattatatattataaataatatttttgggccaggcacgatggatcacacctgtaatcccagcattttgggagaccaaggcaggcagatcacgaggtcaagagatcgagaccatcctggccatcatggtgaaaccctgtctctactaaaaatacaacaattagccaggcctggtgacacacgcctgtagtcccagctactcaggaggctgaggcaggagaatcacttaaacctgggaggcggaggttacagtgagccgagatcgcaccactgcactccagcctggcgacagagcgagactccgtctcaaaaacaaaaaatacatacataaataaataaaatttctgaactcattgtatgtataaatgaactctcgatttttaacgttaattcgatatctcgttactttattctcataatgcctttagtgttggttttccacttatttacattttttttccataggatgtttgcttttggcatagacacttaaacttatcagtagaagactttagagtttctgtggtaggagtgggcaagaaagggagtctcaactgtgagctgccttatagggtaatctcactgggccctttccttggggactccagattcaatatcatgaagttcttgagtcaaatttctgcaaaatgactctttcaaccttctgctgggagggtgtgatcctacctacatgcattctttcaactatgtcagaagagtctgggaatggtgggtctttgcttttgtatacagacttttttttgttttttttagatagaattttgctctgtcgcctaggctggaatacagtggcatgatctcagctcactgcaatctccacctcccaggttcaagggattctcatgcctcagccacccaagtagctgggattacaggcgcctgccaccacacctggctaatttttgtatttttggtagagacagggtttcaccacgttggccaagctggtctcgaactcctgacctctggtgatccacccacctcagcctcccaaagtcctgggactacaggtgtgaaccaccatgcccggctttttgttgtatattaacctttgccaaatttctcttttttcaatatagggcccgagtcttaatattaagtttagtctcctcaaaataagaatccactgttttacccttctaactaaaaattatctagcctggagcagatctcagttttgtgggccctgaagcgtatgggatttgagggctttgagagaatgaatacaaaaataacttacttttgcaaattaaaaaaaaaaaaaaaaaaaaaaagacttaccaggcatagtggctcctgactataatcccagcaatttgggaggccaaggcaggcagactgcttgagctcaggatttcgagaccagcctgggcaacatagtgaaaccccatctctactaaaaatacaaaaactagctgggtgtggtggtgcatgcctgtagtcccagctacttgggaggctgcagcgggagtatcacctgagtcctggaggttgaggctgaagtgagctgtgatcaatccatgcactacagcctgggtgacagagtgagaccctgttttaaaaaaaaaaaaaaaaagaccattttagtacatatctcaggctccccctgggttcttggaaggggctcatccaagtgcagtggcccaaaactatagcacactttacctcatggcaaatctatattcagggagttcaatagtcctgaacttcaatagtccctgaagttggggaaaattgcttaatggtgtaaaggagaaacttggtggtctaaatcacaaacaaaatttgaatcaagaagacctttaacctccctctcagagtcacctagtaatatcaatttctaagctttttatggggttttgtgctacaataagatcaattcttggctttcctcatccctggcctagttttcagctttcttgggtttgtcaagtcagttttcattcaccatctgctttttggtgtccagaaatgttgttgctgttgtctcctttgccattcttgttgttcctgggagtctatgccatttaaaaaatctctttcctgtcattttattaagagttttagaaaagagcagagggcagtgtgtatattcaaactgcccttcttaaggcaaagtctgatggtgccaaattgtacttcaaaattgccccccaaatggtgcagcactttatacttctggcagcacagcatgaaacagccacttactcttaccagtactccatattcttaaaatttaccaatctggttaaactatctcattattttaatttgcatttccctggttactagtgaggttcagtgttattttatacgtttattgaccctttgtttttcctcttctgtgagtaacctattcatacaatttaccccccacccttttttttctttttgagatggaatctcactcttttgctcaggctggaagtacagtggcgtgatctcagtccactgcaacctctgcctccccggttcaagcgattctcctgcctcagcctcccaagaagctgggactactggcatgcaccaccaggcctggctaacttctgtatttttagtagaaacggggtttcaccatgttggtcaggctgctcttgaactcctgacctcatgatccgcctgccttggcctcccaaagtgctgggattacaggcatgagccactgtgcctggcccaatttacccattttttatagtatgtagtgaaggggatcagaacatgctaccccaaaatatgccattttggtatactgaatttttgaactgaaggtaactgagaaaatgcagatgcccccttactacacgaaagcagggcataacatttcccatgagagaggtacccttctccaccataccataaagagaacattcttctcactggagatgaagagttatgccaaaataaatctgcataaacaaacctcctaaagtactccttatcttccattggtttctcccatatattttctgttcactttcccacaatttaccacccttagccaaaactccactttcctttgtcttgtcacacctccacaatttgtcattttttgttaaaacggtatataagtgctcaggcctatcttcttctatgggtcttcatgaaggcctgtgtgtatacataaaaatattaacattaaataaaatttgtatgcatatgcttttctcctgttaatctgtcttttgtcagtttaattcacagccccaactatagaacttaagagggtagaagaaacgtctttcatcccttacagtagttatctttttcttactgatttgtaggcattctttatatttgctaaattgttttatgttatacaaattgtgattttttaactttatttcatctaaattctaagacatttaaaattttgatgtaattttgctttttgtgtctatataaggcagatcttccccattccaaggtgttaaatatgatttcttttaatacatgtgtggttctgattttcacatttaggtctttaacccatttggaatttacttttataatggcaggggccatttttcccacatcaacaattgtaacatttattgaatagtctatcttttacccattgatctgaattgtcatacttcttaattacaaaaggcttatatgagtatttttctgtttctgggttctctattctttctcacaaatttagtatcttattgaccatgagcttctcaaaactgcactttatacaggaaatatccttgcaagaaattaaatagaaacttgctaatgttataaaaatatcaattatagattgaaataaaatgactaatatttattacacaagtgcttagttacacttatctgaaaattataataggacaattggtgcatgtcacattcatattactatccatataagaacaaatacatttagtcaactatatcaggataacacacaaggtttttgtttgttttaggcttctcagttgaaagaaaacatcgagtaaggaaaatgaatttccagtgattaagtattaacaatataaataataaaaattacttctaaatgtcttacattttgacaactttgaattatacttacatactaatatttccaaaaatcatttaagttacaagggtcactgtcagggtgaaaatatattttgaaaagctttttaaagatatgttattattatgctttaacatcatttcatttattcttggcacacacggcatcttggaaagtaaaaatacatcttgccaattttctgctattgtgcagttacaagagaaagagaagtgtggggcagacagacctgtgttcagttactagctttgtccaaaattgtgttgaggctggtcaattaccttttggtgctgggagtaagattaaattaaataatgcatattttaaatgtacagcatgggcactcaataaatgatatactttaccttatttattcacattgaagtaatagcaaaatatcacagttctatgttgtggtacaatttgaaaaactgaaaaaattgggaaattaaaaaataataatgtgttttgaaaaattgcactttttataaataaatccttcagcaggtttaaatatttcctaataaaacttagtgcctactataccctgattttttaaaaaaaggcctaaaatatgataaaaatggtcagtggttaaggacttttggttttcctttgtgctattgatataaaaataatggctttatttaaggcttagtaagtgattatttgtagttgccctgaaccaaatcattattctcaatgttgcactcagttgaaagagacctactaccttgaatgaccatcatagagaaatgcccatgatattctgttaatataattgaaccaatcataccctcctttttgattgaagtaaaggttcatttggtggcatgtggcagttcagcttgtctcccattaacaatgactcatatacacaatcacaaatcaatttttctcatgctaaatatgtgatgtttggaatatactggattcctgaaaattaaatttatattttcacaaggaatagactattctagactagcaatgcttatatccctattcttggattgttttgtttccaactctgactatctaacaagttcatccttccaaatttgactcaaaaacccctcctccagtaaactttgcctaaccaaagttcacacccctccatttatgtcccttacacgcatgtataatgtacattaacttgcatacactattatttatattttgtgtgctttcgacttttagttataatgttgtctttgactttttttagcctccacagtgtttagcgctgtgctacacatgtatatatgtggctgtgtgtgtttgcatgtgggattgtgtttgtgtatgtatatgtttatgtgtgtgtgagttgaatgaataaaaaactaaagaacctgggcatctgtagggtagaaaagttttgtaatttttcagaaaccaaaattgctggatcttcctaacattaaaaaatctgatttccaaagcgatttcagtttggttttagatatgtcaataataaaaaggcagtgggaaaaaactgtttaaaaccctttatgaaatattctaaaaggccttttagcaaattattattaacagcaccaaactaaaactttttactaaatagtggtataaccttttatatgactttacgaacatagacttctctattcaagacaaagaatactgaacaggaataggtgttgtgaatcaggatacaaaaggcaattcactctaagtcaatagctaatgcacattttgcaattaatttaaaaatccctctgtagtacatatgcatgttaagtaaaagaatagctgcagatcttcatagttgttttaacgctgtaaaacataacacaatactgaagtcgctatttaacaggaaaaattttgttcataatagctgttaatattaaaataggatataataataaaaaattattctcaatgtgtatattttcaaatttgcctgacagtgtccttttaagaaatctgacaatttgtagttagataacagacatttgcatttcactttcataattgaaaatattacctacacaataacaaacaacaatatatagtagctttttactgaagcactctgaaatttatatttaaagctttgcaataaagcaaaattcactgtacttttcataagttatattacataacatgtatgctataattatacaaagaataaatacatgaaatgaagcataaaaaattcaggaccataacaatggaatgttttagttgtcattctcaatgttactttatatgtctgcattaagttctaatgtattttaaacccaagaacctttatctttaaataatacactaaaaatatcaagtttaaagtataaacataatactctacatgcctttttttccctaggtcatcaagggaataaaacaagaaaaacagaggcaagggcagttctcttgccacaaaatctctctttgcttccccataaacctttatgtcatttctagagcatatattacaagatgacagctttggcaaagtataagcttatttaagtggcttctttcttggaagaaagaaaacaatttaaactaacaattttctttttggcttattcattctcaatctttctctgatatataatagtggtataaaagcacttcatgaaatgctcactattaatcagttaaatagcacagaatgaattaatgtatataattaatcaaaatatattatcagtatagatactagggcgaggtcctagaatttgttacacgtagagctaaacttgcaagagatcgcatggcaaaagtagaaactttgtgacatatcccagcttttgaaatatagttagaagccaatcgaaaaagcctttcagcaccaaaggtattgaagtgcccaggaagcaccttctctaccagacctctgtccactaattctattagacgttcacaagttccaacatagtcacttatcctgctgtatgggagccagtcaatcagtgatccatcatacacgacgtctccactgaagagaatctttcggtctttgtcatgtaagcaaatactgcccctggagtgacctggcatgtgcataacagtgagctgtctgtcaccaaggttgatcacatcccctacaaatggaaacagagtttacagataaacatgttgtatacttgacttagcatgtaaagcatactagagcattatatgcttccaaagaaattgggaaggatgacactttatttcataaatactgtatttcttaatgatgatttaaaaataagctgcctatagttcattcctattgtttgctagaccagtgtttgccaaagcaagtaatgtggaacactacttctacaggctatcatgatacataaatgaaaaggaggtagttctgtggtcaaataatttgaggaactctcactttaaagaaaattaagcagctttcttttcagaaagacttctttgagcttttattatatgaatgtatactgtggatatatacaaagtagatatagttgtacaatttctcaaacttatttgatcatgaaacttttacttttcagcacatctatggtaccagtatcctgttgacacaattaatgaatgttgctctagggaattttattgtattttgcctcttgtatcaccctgtcagaattagggcttgaggaattgatataaatcatgatgctctaatatgtgagtaataatctccttaatctctgacccaggaacctcaagtcttctgtcagaatacattaaactctggcaggctaacttgcaaatagggtaaaatctcagacttcagttaccgacagcagagaggaaatggagcaacatgggtggaaaattgctctgtttcactggaattaaattagtatgaacttgaagtaaatcatggtaaattaaaagattcataatgtaatctctagtgcaagcacatacacaggaaaaaatttaaaaatatatagctaaaaaataataaaggaatcaaaatggtgtaataatcaggatttggtaaacataaaaaggcagagattgtcagactggattaaaaatcaagatatatgcagcctacaagaaagaaactataagaccaaagacacaaataggttgaaaagcttaaccatattaaatattactgttaagagaactagggcagctaatattaatataagacaaaattgatttttacatgaagaatattactaaaaagaagtaattttatgagaatgtacattaaatcaatacattgataaataacaattataaatgtacatgcacataaaacatcaccaaaaatacatgaagcaaaaacaaacaaacaataaacaattcaacaatgatacttggagagttcaatattcttctctgtgtaattcataaaataagtaaatagaaaatcaataaggatatggaagacctgaacaactcttatcaaccaacttgacctgacaaaaataaaacactttactccaaaacagcaaagtacacattcttttcaactgtagttgaaatattcaacaggctataaagctaggccataaagcaagaatcaataaatgtaaaaggaataaaatcatacaaagtatgttctctgcctacaacataattaaattagaaataacaaaatgaacagaaaattgataacatgtagtctttttgtttgttttttctgagacagagttttgctctctcgccccggctggagtgcagtggcgcaatcttggctcactgcaacctctgccttccaggttcaaacaattcttgtgcctcagccagctgagtagctggaattacaggcgtgtgccatcacgcctggctaatttttatatttttagtagagacagggtttcgccatgttggccaggctggttgccatgttgccaaggctggcctcaagcgatcctccctccctggcctcccaaagtgctgggattgcaggcatgagctactgcgcccaaccttattatgtgtttttaatagacaaaaaataacaaattaggaagaacaaaaataaatatgggcaatattcaaatatatgtaaagcaaacagcaaacttctacattgtttatggatcaaagaagaaatcaaagggaaatataaaaatattttgaatgaatgaaaacaaaatcaaaacatatcaaaatgtatagaatacagctgaagcagtacttagaagaaaacgtattgctttaaatgcttattttataaaggattaaatgtttaaaatcaacaatcaaattactatcctaagaagttaggaaaagaagaacaaatcaaacacaaagtaagtgttaatagaaataataaagggcagagcaaaaataaatgaatacaaataccaacagaaaaaaacagatgaaaccaacagttgtttatttgaaaactacaacaaaattgatacacctttagctagacaaatcaagaaaaaattagagaagatacaacttgctaaaataggaattaaagaaggaacatcactacagaccctgaagaaattaaaaggagaataagggaatattatgaacaattttaagccaacaaatttgacaacttatttgaaatgaacatattcttaaaaagagacaaattatcaaaagtgatccaagaagaaatgaagtctaaataaatgtatatcaagcaaataaattgattaacaatttaaagtctccccacaaagaaaagtctgggctcaaaggcttcattgatcaattctgtcaatcattttataacgggacaatttcaaccctataataatttcaacccatataaagactttcagaatacagatgagaaatctaactcagttattaccctcataaaagccagacaaagacaatatattaaaataacaacaacatcaggcctggtgcggtagctcactcctgtaatcccagcactttggcaacatgtgggaggactgcttgaggccaggagtttgagaccagcctcggcaaaatagtgagacctccatttctataaaaattaaaaataaataataatttaaaaagccaagtagggtgttttgtgcctgtagtcccagttactcaggaagctgaggtagaaggattgcttgagcccagaaatttgaggctgcagagatctatgatggcgccattgcactccggcctgaacaacaaagggagactctttcaaacaaaacaaaaaaaagcctatacacaaatatacctaatgaatgcaatcttaaaattattgacaaaatattggcaaatcaaatccagcaacttataaataggaaaatgaccaagtgaagtttattccagaaatattaagtttggtttaactagtgaaaataaattaatgtaatatactgtattaataaaggagaaagccatatgattatctcaatagatacataaaaagcatatgacaaaatccaattctcattcatgataaaaacttccagcaaactaggaatagttggggaaggtcctgaacttgataaaagtcacttatgaacatctataggtaatacctctttgaatagaaagtctcctaagataacaaggcaaggatgtctgctcttaccatttctattcaacattatactgaagatcctagacagtgtaataagccaagaaaaagagagtaaggtctcacagattagaaaagaaaatctgtctttatttagacataatcttacatacagaaaatcctaagtaggaaaaagctagagaactaaaaagtttaccaatgttacaggataccagatcaacatacaaagataaactatatttctatatgcttcaagtaactatcaaaaatgaattttaagacatttgactcaaaatagcatcaaaaagaataaaatacttgggaaaaaatttgacaaaagatgttttgtaatatatgaacactgtataatgaaaactacaaaaacactgtcaagagaaattaaagaagacctcaataaaaggagagataggctatgcttactgactgtctcaatatcactaaggctcaatattgctatgatggtaatgtaacccaatttttccaatagctacactgcctaataaaactttctgcaatgattgaaatgttggttctcaatactgttcaatatggtgtggctaatggtgcttgaaataaagctagtacaattaaggaattaaaattttaattctaaccaatcttaattatttttttaaagagatggaatctctgtcactcaggctaaagtgcagtggcccgcttatagctcactgtaacccctgaactcctgggctcaagggatccttccaagtagctgggactacaggtatatgacaccagcccagctaacttaaaaactttttctagagacaggatctcgctttgttgcctaggctagtcttatactcctggccttaaatgatcctccagcctcagcctcctaagtagctgggattacaggtgagtcaccatatccggtaatcttaatttaaatttgatagccatacatggctagtggctactgtaatggccagtaaaaattcaacataatctcaatcaaaatcttgatcttttttcgaagaaactgaaaatctgactctaaatttcacgtggaaatgcaaatgacctagaatagccaatacaattatgaaaaagaggaacacagtaagaagacgtatactaatttcaagagttacaataaaacatcacttctcagtcttttggctaagatcaagtgtacaataaagctacagtaatcaaaatattgtgttactgactaaatagacataatcgatataacagagagtctgaaagtagacacaatattgtcaatagatatttgacaaaagtcaaacaagataattcaacggataaaatgacagtctttttgacagactggactgggatactttgtatatccatttgcagacaaacaaataagaatcgagaacctctcaacccttacttcacaaatattcacagaaattaactgaaaataagtcataaacctaaatatgggagcttctagagaaaaattaggggaacatttttgtgaccttgggctagacatagagctcttaaatatgacacaacaatcataaaacacgagacaaaaattgctaactggacttcaagttataaactttcttgcttaaaaagacaccattaagaatgaaaaggcagggcacacattgggagaaggtatttgcaaaatgtacatctgataaaatcttgtattcagaatatatagagcttgcataactcaataataaaaaagctgaatttttaaaaaagattttaatataccatttaataaagtggatatctgattagcaaataagtaccaaaaagatgctcaacatcattagtttttagtgaatgcaaattaaatcacaatcaagtaccactacacactcactagaatggctaaattgaaaaggattgacaaaaccaagtgttgaaaaagatgtgagctgggcgcactggctcatgcctgtaataccagcaatttggaaggctgaagctggtggatcacttgaggtcaggagttcgagatcaccctggccaacatggtgagaccccatctctaccaaaaacacaaaattcaccagaggtggtggtgcatgcctgtaattccagctactcaggaggctgaggcaggagaatcgcttgaacttgggaggcagaggctgcagtgagattgcaccattgcacttcagcctgggcaagagagagactccatctcaaaaaagtaaaaaataaaaaaatgtagttgttgggtagaatgttctgtaaatatctattaagtccatttgttctagggtatagtttaagtccattgtttctttgttgactttccatcttgatgacctgtctagtactgtcgacaagtggagtattaaagtcccccagtattattgtgttaccatctatctcatttcttatgtctagtagaaattgttttatacatttgggagctccagtgttaggtgcatatatatttagaattgtgatattttcctgttggactagtccttttatcactatatgttcctctttttgtcttctttaactgctgttgctttacattttgttttgtgtgatataagcctgcttacctttggtgtccatatgcatggaaaatctttctctacccttttaccttaagttcatgtgagtctttatgtgttaggtgagtttcctgaagacagcagaaacttggttggtgaattcttatccattctgtcattctatatcttttaagtggagcatttaggccatttacattcaatgttagtattgagatgcgacatactattctattcatcacgctatttgttgcctgaataccttctttttttggggggggcggtttgtttgttttttacattgttattgttagatgttatataggtactgtgaggtttatgctttaaggaagattctattttgttgtatttcaaagttttctttcatgatttagagctccttttatcagttcttgtagtgatggcttggtagcagtgaattccctcagcatttgtttgtctagaaaagactgtatctttctttcatttatgaagtgtagtttcactggatacaaaattattggctgataattgttttgtttaagaaggctaaaaataggaccccaatcccttctagcttgtagagtttctgctgttagataggttttcctttacaggttacatgatgcttttttctcacagctcttaagattctttcctttcatcttgactttagataacataatgactatgtgcctaggtgatgatctttttgtgactaatttctcaggtgttctttgagcttcttgtatttggatgtctagatctctagcaaggctgggtaagttttcctcgattattccttcaaataagttttccaaacttttagatttatcttcttccttgggaacaccaattgttcttagacttggacatttaacgtagccccggacttcttggaggccttgttcatttttttttaattcctttttcttcgtctttgacggattgggttaattcaaaagccatgtctttgagctctgaggttctttcttctgcttgtttgattctattgctgagactttccagtgcattttgaatttctctaaatatgtccttgatttccagatgttgtaactgttttttatttatgctatctatttcactgaagaatttacctttcatatcttgtatcatgtttttgatttcttacattctattcatcagcacatggaacattctccaagatagaccatatgataggccacaaaacaagactcagtaaatttaagaaaattgaaattgtatcaagtgttctctcagaccacagtggaataaaattggaaatcaactccaaaagaaaccctcaaaaccatgcaaatatatagaaattaaataacctgctcttgaatgatcattgggtcaacaatgaaatcaaaatggaaatttaaaaattctttgaactgaacactaatagtgacacacaacctatcaaaacctctgggatacggcaaaagcagtgctaagaggaaagttcatagcattaaatgcctacatcaaaaagtctgaaagagcataaataggcaatctaaggtcacacctcatggaactagaaaatataagaacaatccaaacccaaacccaggagaaaaaaagaaataaccaagatcagcctcccgagtagctgggattacaggcatgcaacaccacacccagctaatttttgtatttttagtagagacggggtttcactatgttggccaggctggtcttgaactcttgacctcaggtgatccgccctcctcggcctttcaaattattgggattacagacatgagccactgtgcccagccaccctactatttcttttctttcaccttctctgtcctatctctgcatccattattctaaggctggattttccaaactggtcctcctacttattttagtctttttctctcctagttcccattttcctgtactgatctttagtaagtttttcaactttatcttccagacctgctgctacataatttctgatgttttaaattctaagagttttttttttttggtgaatattgttctatttatttttaaagcatccttactgactcttggatatcttgaatgcaatagcttgtcttatccccctgatgatattgatgatagttccccactctcaaattgctttatgctgtttgttttaatagctgatctcatgttagagaattttctgtttttttataatgcttggttgcctatttaagagttggggggcatgagtaaaaatggctattgtcaaaaagacagaaaataacagatgctgacaaggatgtggagaaaggggaatgcttgtaccctgttagtggggatgtaaattagtacagcaactacggaaaatggtatggaggttcctcaacaaactgaaaatagaactaccatacgacctagcaatcccactgctgggtatgtacatccaaaagaaaggaaatcagaatactaaagagataactgcattcccatgtttattgcagcaatattcacaatagccaagatgtggaattaacctaagtgtccatcaacagatgaatggataaagacaatgtgggaaaatatacacagtggaattattcactcataaaaaataatgaaatcctgtcatttgcagcaacatggatggaactggagggcattatgttaagtgaaataagccaggcacaaaatgacaaatatcccacgtttatactcatatgtgggaggtagtgctagtatggtggttaccagaggctggaaagggtaggggggaagggaatgaagagattggttaataggtacaaaaatacagttagataaaagaagtaagttccagtgtttgatagactagagttaacaaggatttattgcatgtttcaaaatagctagaagatttggaatgtttctgacacaaagaaatgataaatgtttgaggtgatggatattctaaataacctgatctgatcattacattgtatgcgtttatcaaaatatcacacgtaccccataagtaattacaactattaggtatcaattaaaaaaaagaaggggggacaagaaggctgcttgcagcacatgcatggggcctggtgaccaaggcttcacagtagagaaagaggccaggatttcttaggtattcctctacattggtatcttagtctttcttctaggaggcagattccctagataacatttttctaatttcctacctgggtggggaaaggcctggctctcatccttctaggaaactagtagaacacacacacactctttctcctgtctctcatccttctagaaaactagcgcgcgcgcacacacacacacacacacacacacacacgctttctttctcctgttttccatactgagcccttaagctcaacagtaatttggcatccttcaatcaagaaactcctttgttttactatccccagagaataaactaattggatgggagagggaggggcattcactagagttttaagagcttcttaaaaggttttcaagaaattctgcttactcttccctttgccgccactgaggtactactgcctattgcaaattcctgagttttttaaggcttcagcggtgcaaactgaattggctcttaatttccctttgctggcatagtataaaactgttaacttagtcaccacatctactttctagcatccaaaacagttccccccgccaatggggatttaaattgaaatcacgattttttcacagttcaacagtgcttcggaagagagccaaattagatgtgtctgttcaatccaccaccttcctacaacctgttttagcctctgcaaatgacttaagtccacctgaaaccactcctctgagataatatcttggtgacactgggcatatggtttaaacatgtatgtaatagggatcacaatgccagaactttgtatcacttgactatagtgaaaaatgggcaaaatgatgtatgcccactcgagaggtatgtactatgtcaatttaaggtctgctgctatcttagaggaagataaccatttcactattagtagggcgagttgcttttttatccagaataatgcactggaagatatggctattctctccttgtccctcatttacaagtcggcttttgggttagagatacagtgcacagatttatgcttctccatgacaagtgatcatcaattcattaaaggaaatgtaataaatgatttcagctccttgcattctaccaaagcaatgaagactttatgctgttcatgtgtgtaactgtatacaaatttttaatacaaatattttatgtatcctcccaggcacctggattatgttaacagcaagttagcaggccacatcattcagaagatacgggaaattaatattcttgagaagagaggaaattagacactacctgagagggtggggcatccagctcctaatgaaaaacaacttttgataacacggataacacagtactatcaccttcaaagtgtttggtaaacattaagctttcttttcacccttttaaaggcttaaagcaccacacaagtagtttgcaggcccctttcagctccaaaaatgttgggattctaccatcaactggaaacctgggttctagtcccagctctttccgagatggggtatgtgacctcacacatgatactcagccctgcatgggttctttcttcatctataaaaaacccctatcattctctcacctttgatttcccattgctgacacagaatcaaaagtaaatttcaaaagtaatttattcttttcaacaatttaagtatattttaataccaatgtaaacatttttgatccgggtgtcagaatttagtctgaatacctatcaactgcatggaaatgttacctctaaaagtacccatttttatcaagaaatacagtaattaggtgtgactttaatgtgaattaaaatttaatgtacatgtactttcatctcatattgtcagataatgtaagactcttatctaaatcagtttttttttttaaatttagatttaaaactttaatgaagacttgttcggtgggtgtgaggtacagaatcttgcaattttttttttagcaccgataagcagtacaatattgcaatttttaaaatatctcaaatgaagatgtcatctgtgagataaactgatttttgtaaaatatttcattatttgccatattgtttggtcataaagtgagcttcattatactgcagcaactgaatttttctaccatatagaggcacgttttaatataccacattggtaattaaaatgatctcacgctaaaggaaagaaggggcctttcacattctactcaaaatcatcatatatttatgaggcaggatttatgtatgttctgcatgccttgatctattgtgcctagattcatatcctagcttttatcatgatctggctcaggcaagccatttaactggggggtcagtggcctcactttaaatgtgttgtgaagataaaatgaaatcaaaagtattttaaaaagaaaatagaaaactaatataccaaatattgctgatgtggcgaattagctcaattatttaagtccctacgtagggagaatgggctgaggccctatttattttcattccatgaatttctctctgaattccatacttgtctttcacagagccaaagaggaccatggctacctatgcattagtccacataatttacctctaccgaaaattacttccttattgatctttctcaggctttgctttcaaccggaccaaatatctgtcataaagtaagactcagacatattctacgtttatgattactattaagcttttgcaatcgtgaggcaacatcaagaacagaaacctatctgaaaggtttccaatcgcattagcggattggaatcactggtctgatgactctctaaggctacaggtgggaactgcccatacccggtggggaccaagctgatgaagtctgcaattctcaaaagcacagatcatgacatgcactctccgtgaggggtcattccttaaaagtctgctcactacgaaagctcctggaaatgtcgggcaggtgcttagggaaagaatgagaaatccctagtcagtcacaagtctttgtagtgttactgctacagccgatgcaggaaagtggctagggagggggtggtgccggctttcaaaggagtactcagaatctctacacgatgccagagctggtctctggcagggaaggctgtgatggccttgactctggtcaagtgggtttttactcagggaagggtgaaacagaagtggctctgcgaggtgccaaaataatcccctttatggccacgcaagtctgcaacatgcggcactcggacagtctcttcccaataccctcccttaacgagagcgcgcgcccgcgggggcccattaccatcctgcaggatgagggtgggctgcaccgcctgtacccggaactgtctggccctccagccggggctgggcgtccgcaccacctcgctatcggaaagccaggtcacggtctcaaagttgtccccgcgagccagcgcctcggcctcggcgtggtgcactgccacgcggtcgaactggtagaggccgccggagtggtcgaagtgcacgtgggtggccacggcaagcagtggccggcgcgccgcgtcctctttggcctctcggtcctgcaagaggccggaggagtacaggtactccgggaggctgcgcagccccaggcctgtatcgatcaccacgtcctgctcggagccgcgcaccagccagatgttggcacggttgcccgactcgtagaaacgttcttgaatccagaagataccatcgcctagagacttgtgggcgtaccactcgagcgccgacatgctgggcaggggtgcagccaggcggggtgagtgtgggcgtgcgagtctcccacaggctgtccacacacagggcactgcggctgtgtgaagcggtctgcctgcagccagggaggaggcgtagagcgaggcgggggcgtgggatgcgggggtcggaataggaggaggaaggacgcagaccgacgctgcccgtagcgtgcgctcccgcacccttccgccaggtcggcagcaagcagaggctgcgccaccagcacgggggcgcaggagctaccgcagcctcggcagccgcaccacgagagagctttaacgcaggggccactgcagcagaatggagactcaggtggcgaccgtttcgccaccccgggcgtgtgacagcagaggcccgcagtgagggtgggaagagctagaaccgcccacccactggctctgcagggcgcgcactcccagctggcgcagaaagtgtggggcctcgcgggttgtacggcgactacggcgcctgccaagggcaaaaaaacctctttgccgagggggtggggccttcctagggagtgggcggggctagttggtagggctcactccgcggtcctggtgccgcgtgcaggtcggtgcgcgcttctcccgaggtggaacgggcggcagtcaagcgccggcgttctctgccgtcaccctttccttgccggccggcacttcggctgcagagttttgcccacgcttcgagacttagggagcaggtaaccgaggaagcaatcgaagacttgggaggggtggtgagggtagaggggaattaaaggggcacgtggaaaaggtgaggggaagtcaggggtagagattcattaaagcgcctctggtttgaggggcgtttggagatagcttggtacctcccctccttgtcctgctcccttcagaattttttaagtccaatttccagatcttacctagtctctactcctaggactgtttgcagtgagttagaagggtatttatgctcttactgatagtaggttattttcaaaatccatggctttatgattttttaggcactagtcattgccgcagattgcagctgaggaccgactattcagtatctgttttcgtaactgttggcactttatatcgtagggaagggagttgttaatatggtttgtcttttcttataaaaaataaaattctatatccaccctttttttaattttattattatttatttatttatttatttattttggtttgtctgcccttggaagagagtaaagcgagttggtagaaaggctcaaataaagaaaaggagcacctggtgaggacgggaaaagtgaataatgactgggtgtggccccgccagccacataaatcatccgctctgttaacatcaggtcactgtctccactccccgcttcccagctattgaaatatctatttagggtttttgtttgtttgtttgttttttgagacagagtctctgttgcccagtctggagtgcggtggcgcgatctcgtctcactgcatcctccgcctcctgggttctagcgattctcctgcttcagcctcccgaggagctgaggttacaggcgcctgccactgcacccggctaattttgtatttttaatagaaacggggtttcaccatgttggccaggctggtcttgaactcctgacctcaaatgatccgcctgcctcggcctcccaaagtgctgggattacaggcgtgagccactacacccggccagaagcatctatttaggcttcagaaattcccttgagaacttaactaacctcttaagttagtcaggaaaaatgataaagagactcatgagacagcattacaaaagaattatgataacctttactgtgacaactactaataagccttcatggaaggagaggtgtacgctcctttcctaccctcctaaagtctttggtgggcatgcagcttttctaaatactttgctaatcttcacagagattattcggttactcagctgggggctttccttatgcacaagtcgctgagctgggtaattcatgaacagagttgtgtaaaaaggtcataatctggattctcaggagtttgagggaagataatgtctgtacacaattacttgcaaaataaagcattacggggtatgtaccacagaggaagtaaaagctagattcagtaagaatacaggtggaagggattcgtgaggagtggcttttgagctggccttaaaagactacttttagggcattctcagcagagtaatatagggccctcagtagtctgggtactttttctctaggcagaagcaagccactagtggtgaaatggagtgatatctctaccaggccatgagctcagcaataatttatccaataatcattggccttttgctaggctttcgttagtaatggggacataaaaaggagaataagtttccaaggagaccttcacacttccaggtccccctgcctgcatcccacatctcactggatatccttttttaattctctacatggctctttgccttacttttgtcaggcttatgctcaggtatcaccaagtaagagaggacttcttcagccaccctttccacaatagcatccatgtttcctgtctttatttttcttatcatttcctgacatttcctataaaatatattttgtcagtttcttaccctagactatgagcttcatgagaggagaaattttgttttgttcactactgtattcccaattcatagaagacggcctgacgatgagggtgcttaataaatacttgattggattgaagaggctccctgggagacagataagagctgacagttacaacatgattgtaaaaagggcttaaaagcagagtagtacttgggaaacacagagaagggagaggcctacctccatgtagggtggaagaaattgtcatggagaaagtgtcatttgcatggcatctgaaaagaacctggggcttaagtggatgtggcaggaagggcactccaggcatgcaatggttgacttggccacagcgtggggtgcctgtggtgagaggcagaaagactccaaagctctgttaaggagagtcacatgtcaagatttgtattccagaaagataccctagactgcagagtggattgaaagggagaatccggccacaggaagtttatttgttctgttttagaggtccaggtgagagatgagagggtctgaactgaagcagaggtggaagaaacagaacatgggagagagaacagagctggtaaacctctactattagatgaggggttggaagtagacaggtcagaatacctatcctgattgtagcaatttaggggtcattcatcaggaataataccgtgacttgactttcactgcctcctctagcttctatgtctgcttctatctgtttgtgcatttattcatggagctgacgttgttactggtggagggtgtccaggttcttggcgtcttgaacaaagaattggacgaaacgcgcaaagcaaagaaagaatgaagcaacaaaagcagatacttactgaaaatgaaagtacactccagtgaggcagtgggtggagcatatgggctcaagggtccccttacagaatttgtgggggtttaaataccctctaggggtttccatttagttacttggtgtacaccctatgtaaatgaagaggatgaagtaaagttacaaagtcatttacttggcatatgccctatggagaggatatttcctgtcatagccgtaatgtgaattggccttttgttccctgcctccagaccctattttcctgcctcagtgtggacaaggaactgtgtaagacgtggaggacaagacatttcagttacctcataactcataaaatgttagaactaggaggaatttcagagattagctcagcatctgctaggacgttgttttggtagttgattaaaattgacttttttatttcagctcttggatgcttaaactacacccattttcaaacctctcagaacaattctgaatagaaattttcaggagacatcctgaaatggaaggggcaatgctactgattttacatttttaattgagtctgttttgcagttattaattcacttcattgaataaagacctccctgggattaaaaaagtcttctaaccagcctagacctatgcttcctgaagtgtaatgcaaatggaagaacagtggaaaggtaaagcagtcctgcttttgttaggaattagctttgcgtctttaggtaatcaagtaaccgcttagggtgttgctttcctcttctgtaaaatgggaggtttaatctgcgtggttctttttttttttttttttgagagggagcctcactctgtcgcctaggctggagtgcagcggcgcaagcaacctccacctcccgggttcaagtgattctcctgcctcagcctcccgagtagctgggactacaggcgcgtgccaccatgtccagctaagcctgtagtcccagcactttgggaggccgaggagggcagatcacgaggtcaagagatcaagaccatcctggccaacatggtgaaaccctgtctctactaaaaatgcagtggttcttaatttgggttgcacactgtaatctcctgggatgctttaaaaagtcctgatgcttaaatggtacctccagagcttctgattttattgttctggggtgaatcctgggttttcttttctttaaaacctctctcagtgattccaatgtgcagccaggtcccactcaaagaaagggggaaaaaagccttaataatgggctgactgaattgtccttctgtgggtagatttgctcatcaaatcacagtgcacaaatagggtaagcttgacattaattgtggagctgttgctatataggaagcactatggtagacagtagggaggataaaatccctgcttaacacagaaccaacaaacagccaggcgcggtggctcatgcctgtaatcccagcactttgggaggctgaggcaggcacatcacctaaggtcagaagttcaagaccagccttgccaacatggtgaaacccccatctttactaaaaatacaaaaattagccgggcttggtggcaggcaccagtaatcccagctactctggaggctgaggcaggagaattgcttgaacccgggaggcggaggttgcagtgagccgagatcgcaccaatgcactccagcctgggcgacagagcaagagtccatctcgggaaaaaacaaacaaacaacaaacgaaaaacataggtgaaactcctcccctttggaaaagatcaatttcccaaaagtggtattctatttctttgaaaattgacaagtgtggcaacatatatcacctgaaattttttttttttaatctgtgttttaacaggaggatctttccaagagcaatgtgggatgaagtggttgttgtggttgctgagggacttaaactggcttttttggtgaaaagggatgtagcaagtcagggaggcagagggagtaagttgcagtggaaagactggtattcaagacatgactatagtgagtcaggagaatagggtgcaaccatcttaaaagggctctgagtaaatagggagtttggatttaattcagttagccaagagggaagatgaggagagtagcagaatcaaaactgtgctttaggatgagtaatgtggatccataaattaaacaggaagaacaagggataccacaaagtttgcagttaatcagaagtgaggtgaaaaaggactgagctggattatggtagagaaattgcaaagaaagtgacatttagaaagaatatgattgatcagtgctctctggctcctagcacagtgcctggaatgctcaatattggttgaatgaatgactcaatgaaattgggccatatgaagtagagaaacatttggagcatgaggaaatatagaaagcactaaaactcctttattctagagtttggtgtattgaaaaaggaatgagacagtggttaactcaaccacagtctcacttgtaggctgtttctttcatgatacatttaccaggatccagggactctctctgagctctgcaggagaagaaaatgaatttatcagctcctctgtgtacagggtaatggattcatgaaaactaacttaaagagatgggtttgtaggctggaatgccacataattattaaatgtgtcaaaagctaggaagtttttctggcaagggtggtaccttcgctaatgatagcaattcatacacccaaagattgcttgataaaaatggaaatttagagtcaatagagtttgttatttttcaagagctgttccatgaagcagtgctagctggtgtcctctttttttagggtgagttttccaaacttttccagggcccacctccaaagattctggtatggtaggtttgagggcttgaagaaagcctaggactctatgtttagcaggtcctccagttaattttcatgatgaggaaagtctggtaaactttacctggaattgtttttaatctttaagtagtggcaaatcctggactggagtgcagcccagtggttttgagtaggcctagtgggctcttgcagttgtttcttagagtgaaaggtgtgaccccttctgctcagcagttttgatacttgggagatacgctttctctaggctcagcatatgttttagtgactcagcaattgaaacaagtccatttggatattttcctgcttttttaatgtagagagatgtaataagctgggctattaaaataaatatagttcctgtatgaactttatttcaaggtaactaaataatagataagagaaattgatccctggtggaattccaattaataaaacagaaagaaagataaaatttgtataccaccattttgcaattcataatggaaaaattgatctagattgtgatcatcagtgactgctaaaatcattaggtgaaaactgatggacactttatacttaatgaaatagaccaacacctgaacccatgaccagcctgatcaataccaagagggagactttatgttcatcttgatgtaatagagaaggaaagagagagcatcccttttcagtattcttgaaaaaaaaaaaaaaatcaaacccaaatctaaacctctagtttacctgtttattggaaatacacccagagaatacaggaatatgttaaatcacatctcaggtataaatcagtcaaatccagaatatgggaaattatatagctttgctactttcaaagtatggtttacaaaccagttgatgtctcctgagaccttgataaaaattcagattctcagtttctgtctgcagccaactgattcaaaatctgccttttaacaagattcctaggtaattctcttgtacctaaagtttaagaagcattgtatagggcactgacctagtttcttagacaaatagaaagaaaaaaaaatgggaaaaccattacagtttaaaagaaagttaaatgtcatgtattttttatatcttgatttgaacaaattaactgtaaaaacatttatgtgataactaagaaatgtgaatgttagttctatataagatgatggtatagagttattgttaaaattgtagatgcaatgttattgtgatttttttaaaagcccttaactctgagagaggatacatactgaagagtttaaaataatctgaagcatgggagtagaaaagtatagttaaagtacaatagtcatatacggataattttgaagctgagtagtgggtatatggagatttaatatactgacttttgtgcatgtaagtatagtaaatgtaagtattagtaaaccaaaaaaggcatagacttgtagtttaaaacgacaacattaaagatgacaaatcaacttttagtgttcaagcagttatgaaggaaaactcaaatatggaggcctgcagggataaatttacgaaatgaataatgtaaaactatgaaacccaaagggagggattgaaaccaactttgcaaaagtcataactgagaaaattatgacagtgaaagatatcagacctaattgatcccatcttgcttctaacctctgaactgtccttgttcattcttgggcgtgaaaccacctttgcaaaattatgactgagacagtgaaagagatctaacctaactgtgactccatcttgcttctaacctttaagctgtccttgttcattcctgggcataggctgaactaactttgggaggaaattagtttatggtttgaaacaaagacgataacagactttcccaaaacaaacctcctccttgcctggggactagactgccattgtcggactaagaaattattcacaagattagaaattatagtttcggagtcatgcagctggaggctacaagattctgaccctccctaaaccactccaaagatcagtgcttgagatattttgcagaccctgcacttgatggatcagggggcactacccagatcgattaactgactcttctgatcttgtggcccccacccaggaactgactcagcagaagagaacagctttgacttcctatgatttcatccccgagccaacctatctgcgcttccagttcactggccccctacccaccaaattaactttaaaatctctgatctctggctgggcgcagtggctcacaactataatcccagaactttgggaggccaaggcgggtggatcacctgaagttgggagttcaagaccagcctgaccaacatggagaaaccccgtctctactaaaaatacaaaattagacaggcatggtggcgcacgcctgtaatctcaactactcgggaggctgaggcaggagaattgcttgaacccgggaggcggaggttgcagtcagcggagaccatgccattgcactccagcctgggcaacaagaccgaaactcctccgtctcaaaaaaaaaaaaaaaaaaaaatctctgatctccgagttttcggggaaactgatttaaggaataataaaactccggtctcccgcacagccagctctgtgtgaattactctttctgtattgcaattcccctgtcttgataaatcagctctgtccagacagcaggcagggtgaacgccttgggcagttacaaaatcatatctgaaaatgttctcagtatcatagccattatgtcaaatcaaatgccgtgcattctacttgagtaattcacagaaaacaggaaacgatgtttcattacataaagatgttgaatatatgatttgcttctggggccttaaatgtagaaggacattaaaattggccatcattggcagggtgccattggccgggcacggtggctcatgcctataatcctagcactttggaaggccgaggcaggcagatcacttgaggtcaggagtttgagaccaacctggccaacatggtgaaaccccgtctctactaaaaaaataagccgggcatggtggtgcgcgcctataatcccagctacttaggaggctgagacaggagaattgcttaagtgagggagggaggttgcagtgaaaaaaataaataaataaaatatttaaaaaattaaattggctgtctaaaagtgcaatgccttgttactgctattccttgcaaatgaattaaaacttggactgccacatcctgagtgttacatagatttacagcaattatagttatcttacctttaaggcaaatatttttaagttgctaaggctaattttataattttaaacctcaaagatgagatctatgaagtccttgattctacatgtgtattttaactcaactactccttagtagctaagacttccaccaaaacagttctaccaatactcttaacatttgctgtgtattagaatcacctgggaagcttctaaaactgactcttgcccaatcctcaccccaagagatctggattgattggttcagttcagtgattcacagaacttagcatacatagaattatctggaaggcttcttaaaacaccagtgctgggcccactcacagtttcttttttctttaggtctgtggtggaactcacagtttgcatttctaccaagttctgagtgatgctgctgcagacagcactctttgagaaccattgctctagtttcttaagccacccaagtcattctaatggcagccagggttgagaactgagagccgcttgctttgtagtgttggccctgtgataaagtgagctgggagttttcagccttttggtccaaaatagtgcctatattcaaattgtagacagtaaaattgatataaagacgtagcaccttgttggttttacgtagtgttccttcaccattaatgtggtagactaagaagggtaacattaatgaccaggcaagaaaccctggtgaagagtagagcagctgtgtgaagtactgtggcttgcataattttgcaaggagggcaagtgagtagattcagaaatgagactgagctgatggggccaaaaccaatgccactcctctgacttcctccgagtggtccaggggacataccatttctctcttgggttcaaggggttaaatgaggctcagtattatcagcagggaaagaaatgtaaagaatgtgcattataatcatcactacagttgaatgcagacttctattgaaagaactctagcgtagggatccctgtttatacattggcagctcagttctcatagtataatcagaggattcaaacgttcaatacaacttgcatatgtgatatcactcctgtctccaaaattgaagagtacaggtttatcataactttaatgattttaactgtttttctctgaattttttttttcttggacaggcatctttcgagtctcattgatcccattcccatttctagaaggaagacattggactagatctcagggattcttccaaacactcacatgctaagataaatcatttaaagtcttaaagtatatatgactaatgatagtttttatgttgacatgaaagatttcttctcctcatcagcctggtcttgtcttgtgtccactttttatgtacattacatctgagatcctactgccaaaccacagaagggtgggtgaattgcgtggactggatgtggggcagtagtgggtgagggggttgaagccatcattatcttacctgccagaggtgtgtgagtgtgagcagttcaacagtcagttgtcacatgtttatttgtgtacatgttttgctttccaaaagtattttaagtcaactgtgctacttaaggggtgcagttttatattttgctttaaagtgttgatttcttttttatatgtgatccagtaaatcgtaatcattaatagtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgtaagtatatgaacagttgaattctcatagtgtgttttttcatttttcagagaatattaaaattctatatgggactggatgtatgattatagcatcctcaagtataagaaagtaaaggagagtgtgtttcacttacctttaaatattttcatgatctgctttcttaaaatatagaaaacaaaactgtatacatctttccatgaatatatttagtactatgtgaaccagtaaagaattagttttcaattcttacaacttgtattggtgttattgataaattccaatatgaaaataatagttttaaaagtcattaggttttataatggttctcagttcgcaccctatcacaccttcacttaatgattttcttatcttgtatctatagaatttaagtttgctccttagtataccacttgactttttcccccactgaactttttttgcttattttagtgttgttttaaaatttagtgagtatgctgcaagcttaatttccataatatataatgttttcgctttatgtttagtttagaatgtatccagggatctagatgtatcacacaaggagtctctgcgttttgctcttggtattttacctttttgatattcagcgcagcataaaaacaaagacaaatatctcaggtattggcataatgtcactttacagtgcttttaaaaacaagctcttttccatgtgtgaggagattacctctaaacactggggatgttagtacatagtatttctttatacttggaataaaattaaaattccttactactgggtaaaaggctctgcccgatctctccgttctgatgtctctctgaccctttttctaccactgtcctcattccccagctacgcaggtctccttgggtcctcaggcctttggccctgctggttctctgctggaaccatctcttctctttgcatggatggctccctgattttatcccaatctctactcaaatgtgacctccccaagaggccaggcatgctcaccctgcatagattccacctccatcctccatgcactgtcagtcatttttcctttacccaccttcatttatttttatgtcatttgtcactatgtgaaattgtatgtcacctcatttgtttactaatttgttgtatgttgctctcctagaatgtaagttccctgtgggcagggactttgacttatttatcatggtatcctccatagtctaaacatgttgagtactcaataagtagttgcagcatgaatgtatacattcctaatcaaattttgaaaatgtaccttatctttatcctctgaaatcagaaatgtctttactaggtaccctggagatccacttgttaatgaacatatttgtgtaaatatatacacacatacaaacgcgtatttgtgtatatgtatgtgtgtgtataatttttaaaacttgaaatgcagcttcaaactccatcttgccatttattcacttctcaatttcttcactgtaaaaggataaatattggtagccctttcaatgagatactggatgttggatattgagtatattgtagtcatagcaaccacttactaaatgatagctgctgcttttttatttatttatttttttccaataataccaccactagctgaggttaataagaacctaaagcagctgctctcatttgggtaccttagtttttctttttttttttggtacattaatttttttttttttttttttttttttttttgtgagacggactctagctctgtcacccaggctggagtacagtggcgcgatcttggctcactgcaagctccgcctcccgggttcacaccattctcctgcctcagcctcccgagtagctgggaatacaggtgcccgccaccatgcccggctaattttttgtatttttaatggagacagggtttcaccatgttacccaggatggtctcgatctcctgacctcgtgatccacctgcctcggccttccaaagtgctgggattacaggcgtgagccaccatgcacggcctggtactttaatttttaaagtagataatcacataggtcaacagactgtttggcaaaatgattattggtgtagttttcagggccaataggaaaattacgcatctttcttacctctaatagaagagcaaagtaggaaatgggttaacaggttaaatagactacagaagttcatcttttaagttggttgtaaaacttagtgcctgtaaaacatagtatttcaataaaactgctgttttctataatacagataaaagggatattaaaatacataattgatttgaaaaaaatctttgtctcttaatttaaacaggatacagattataaaccagtgccactgaaaacaggagaaggtgaagaatatatgctggctttgaaacaggagttgagagaaacaatgaaaagaatgccttattttattgaaacacctgaagaaagacaaggtactgtattggagtctttgattatgtggcttaatgtatacagatgaaacagtgtttaagcacaagatatataatcatttaatgttgattgattcgattcaataaaaaattatcaactactttgaaaaagctatttatgttgctttaacagaaaaaatactttaaactttttgatattttatttttagaaatatctttcattataattttatatgttcagtgaaaattatgaaaaacaggaaaattttaaaaagtaaaaattacccattcttatgtctagagaaccactattaatattttagtatatattccagattttttcttatgcatgtatattctctttacaaaattagattcacattactttgtatcttccttttttcactcagtagcatattagcattttcacatatccttattattcttggaaaacatgacttttaatgactggtagtctactctgtggatatattattattaactgtaactaatttcctgctttttaaatattattttcagttttttgcttgtatatataatgccgtgattgttatcattatacataaacctttatgcatgtctctgattatttaatatttaggttaaaaaaatttttgagacttaattttgtttggtttatcatttaggtgtttgatatgatgtaaaatatgtattcattggtgctgcttagggaagaaaggaaacattatagttggagagggctcaacagtctcaggctagaagtgggaagtggttttataggaaaggaaaccattcctgagtagctgtttagcacagcagtactatattgatttttcactttctgcccttgattgttgagattagagagactgatatcatctttgagttctcaaaacaacatcattaaaacatgagaaattcgtagtgtcatctcattccattcgtattaaaaatgcattccatttttcctctctctctagaatagtttgaattggctgagtcaaaaaaggaagccttatgtaatgatcttagcatgtgcttataattataggaagcattttagacaaattcatttaattctcaaaacatagctgctttaagttatataatggtttgataagaaatattttatctcaaaaatacttaattttttttttttttttttggaaatgggatggagtctcactcttgtcacccaggctggagtgtagtggtacaatctcggctcactgcaacctccgcttcctgggttcaagtgattctcacatctcagcctcctgagtagctggaattgcagacgcacagcaccatgcccggctaatttttgtatttttaatagagatgtttcaccatgttggctaggctggtcttgaactcctgacctcaagtggtctgcccatctcagccacccaaagtgctgggattacagacagacgtgagccaccatgcccggcctaatactgaaatttttaactctcatgatgatgttgcatgctttcgtctgtttgagttctaaaataaaacttttcattttaaagattttaaaaagtaagaccaaatgaactaatcagtattcattcttattagaaaaaatagtaatgcagggtatactttagtgcttttaaaattgatcttttctctatgacacagatgcacttaggtgaatgtggttgttattaaagcacatgtctaatttaaaagtatgtcaaatcagactggacacggtggcttactcttgtaatcctagcacattgggaggctgaggcaagcagatcacctgaggtcaggagttcgagatcagcctggccaacatgggaaaaccctgtctctattaaaaatacaaaagttagccaggcatggtggtgcattcctgtaatcccagctactcaggaagctgaagcaggagaattgcttgaacccgagaggtggaggttgcagtgaactgagattatgtcactgcactgcagcctgggtgacagagtgagactctgtctcaaaaaaaaaaagtatatcatataattaaagcatttatgtgagtgttttagacagggatattaaaaacataattttgttgttggtctatgggagtggttggctagtacttggattaaggggcactttatctttgataactatgcaataaagtatttcaaaatataagggttttttttttttttttgcttttatttctttcaggggaaaactcttgtatagaaatttccaaattgatacaagtacattctccctgagatcttcatgtttacttctgtctttttttattttattgttttatattttattttggagatgaggtctcgctctgtcacccaggctggagtgcagtgggacaatcataactcactgcagcttccaaactcctgggctcaagtgatcctcccacctcagcctcttgagtagctgggactacaggcgcacacaccatgcccggctaacttttaatttttttttttttttttgtagagacgggagtcttgcttttttgctcacactggtctcacattcctggcttcaagtgatcctcccatctcggccttccaaagtgctgaaattacaggcatgagccaccgcacccagcttacctctgtttcctgatatagtgtttaaaaaacacacgcatgttaaaaataaaggtttttctataaaatatatacatttatatgtgcctatataggtttatataatatgtgtatatatgtgcatacataaatttatataatatccatgctatgagtgaaaaagaattggccagactgaagagaacgaccctactgtcagagagaatcatattccggatagagatgttgcatgactgtaccttcgccaggtgcatcacttaccacctgtgtgctttaggaaacagagacttaagggctactgtaaagaactaaatcactagacactaggacagacaaatagggtgagagatctcaagacttcctgatagtcaagtggctggtggctcagggcattgagatcagtcctcaagaactgatggcatggaatgaacatatttcatgttgcgatgtcttcaaagtttgtttttaatgttttcaggtaggattatagaaatgattagtattttctttgcatcgaaatttgttatttatataataaaggaaaaacaccaatgaatattattttagtgaattttagctataagagatcgtctagtctagtggttcccagctcaggttcctgaaccacagggtcctctgaagtagaaacatgattctgacagtggtgatagtgtcataagtcattttcagaacctcaaagcttaatggaaattatacatttacttaaatacatccacaggtctgttactgaataaatggaatttggcttactaattcttgatataccatcagtgtccatgagacccaatataaatttttgacgttttttttttttggagcagttcttattgtttgtatgattaatattgataacttttattcttgcatagaggttttctaaagaagaaacagacattttcttaaaaaggaaaactcattttatcatagaataccatatcagcccattggacccttttatatatctaaaataattatggaatctgagtgatcttattttttctctatattgaaataccttgctactttatcatcatacatattatctcatcactattcatcagacattccccactatgctgaaaaaaagaataaatttaaaaaatgggagaatgatgaaattgactgtgcaattcaaataaattatcactattatgtcatcatatagttttcctatggtgttgtccaaagcattacatctgttttttaagaagttataaagtcttcagagactcttatgtttgtagttgctctgttttaattttcatttaatacaattgaaaatttcaaaaatttttaattttttgctcataatgtctaaaattgacagaaaaacatgttccacaattcttagacgaatcagaagtcaaatgcaaagagatagatagctctctggatgctcatgatgatgatgaaattgattgtataagcaaaatctcagactgtgagtcttcagatgacagtgtcttcaatgaattttctcaaattcaagaatcaatgagtaaacactgtatctccaagaattaaaaaggaattatggtggccttctacagtcaatctttgaaaaagaactcatcatgtaatactttgtaacaaaaacctggaacatcctgtttgctaaaatgagacgatcatttttgttctatgatatttgtgcaccaaaattaatttgatgtgttttgtaactgacaaatgctgaacataaaggcaaagacaacaatgattgaaaggaaattgattatatagacatgaaattgttttctggattgattgtgttaactggtgattataaatttaataatgaaaatattttgcaagtatagagcaaagaagatggctgggccatcctctcttcaatagaagtatgagacatcagccgggcgcagtggctcacccctgtaatcccagcactttgggagtctgaggcaggtggatcacgaggtcaggagatcaagaccatcctggctaacatggtgaaaccccgtctctactaaaaatacaaaaaattagccaggcgtggtagagggcacctgtactcccagctactcgggagactgaggcaggagagtggagtcaacctgggagtgagccgagattgtgccactgcactccagcctgggcaagactccgcctcaaaaaaaaaaaaaaaaagtatgagacatcaaagttttttaaagtattgcattttggatatgtaagtacaagaagaagaattggaagtagtgataagctagattctactagaaatgcatttataatctgaaattatttagatgatacacatatgagaaaaccagaggaaattataagttagaacctattaaagatgtctttggaatctgggatcaggacgtacagaaggcatatattctaggtttgtatgtggcagccgatgcacagaaaactgcattcaaatgactttgcccattttggttaaatttaccttcaaaatcagtaaaacatgtaatataaatttggatttgctatacttaattgcttagtaaaatctccaataactttatttatttatttttatttgagacaggatctcgttctgtcacccaggctggaatgcagtggcataatctcagctcactgcagcctccacctcccaggctcaagtgatcctcccaccgtagcctcccaagtagctggaaccactggcatgagctaccatgcccagctaatttttgcattttttgtagagatgggggtttcaccatgttgctcaggctggtctcgaactcctggactcaagggatccagctgccttggcctcccaaagtgctgggattacatcctgagccactgtgttgggcctagttttattgatttttaagtaacagctttactgagacataatccactatataaaatttactttttaaagtgtacaattcagtgacttttaatatagccacagagttgtgcaatcaacaccactatttaattttttttttttttttttttttttttttttttttttttttttttttttgagacaagagtcttgctctgttacccaggctggaatgcagtggcattatctcagttcactgcaacctccacctcctggattcaagtgattctcttgccgcagtctcccaagtagctgggattacaggcacgtgccaccacacatggctaatttttttgtgtttttagtatagatggggtttcaccatgttggcccggctggtcttgaactcctgacctattagcaatctacctgccccagcctctcaaagtgctgggattacaggtgtgagccactgtgcccagccactatctaattttttagatgcttttcatcatctagaaaagaaattctgtaccctttagtagtcattccctactctccctccttccaacccatggcaccagaaatctgctttctgtctctagagattccatgtcatataaatggaatgatgtaacatgtgtctttggcttctttcacttgccataatgttttcaaggttcattcatggcttagtacatatgagtgcttcattcctttttatggctgaataatattccactgtatggatatatgccacattttgtttatccactcatcacttgatgggcatttgggtcagttcacttttgggattacatgagttatcttgtcataaacattcatgtacatgttttatgtgaagacatgttttcatttatattgggtatatacataggatcatatggtaactctgtatttcacattttgaggaactgccaaacagttttctaaagtggccacccgattttacattcccatcaataatgtatgagagttccaatttttccatatccttgccaacatttcttattttttttttattctagccatcctagtggttgtaacacagtatctcattgtggttttgatttgaatttccgtaatgattggtgatgttggacatcttttcatgctttttgtccatttttgtatcttctttagagaattgtctattcaaatcctttacctctttttaattgggttccaataattggttttcaatatctgttcttttatctgttatcttttttatttattctctgtatttcattatttgaaattaacttaaaaatattttaaaatataaaaagtggtctactgtacccagagaaaaagggtaaaaactgtttttttccggtatactgagggttaaaattatttaaaatatggaaactgttttggagaaaattcttaaaaagaagtcattgtgttacaaattctaggaatctctcatttgtgctgacttcgttttatagattaaaaacttggcaagattagttaaaacattttacctgaagtcaaacagttaaaatacctagaaaaacctgatctcttggtctctgatctactacttattttggttatctttctctaatacgtggttgtattatttggaagcatatacttgacatagaagaaaaatcagtatatatttggtccttgatttttatccattcatctttagtattaccttccctttttcatgcctaactcctgaactactttttatgatgaacatggcttcaagcttttgtgtgatagtgttgctttccaacttgtgctgctggaaaagagtttgtgccctccttaagggtgtttcttgtgataaggtggactagtctgaatcaagagccgcagttatggctttactggttttggcaagctcagagggttcctgcagagttttcagcaattggcatgtagggcttgcagcttgctcatttatgcctcagatcagtaacccctcaccaagtccatccttgcctacccctaccctttttcccattctcttatgtacaaaggtgggaaactccctgtatgtaaaattaaaaatgttgtctgttgttttcaataatcttaaaggaatggcttaagttcagggttactgttgattttcctaatgagttctttattcttttttcccctagatattgaaaggtatagtaaaagatacatgaaggtatacaaggaagaatggataccaggtaactacaaaacacacaatatgaaaacagtttttaaaggctgtctctctcacctcatgttttttttttagaataagttttctatttttaccataggaaaactgagtctggttcttttattgtgattaattagtaatctgttagaaactaaggtgaaaagatttttatgctaaaacaaggaagagttgaagtgcttttgtggaagttcttaaaatatatatatatgtatattttattttattttatttatttttttgagatggagtcttgctctgtcgcccaggctggagtgcagtggcacgatatcggctcattgcaagctccacctccagggatcatgccattctcctgcctcagcctcccgagtagctgggactacaggcccccgccaccatgcccagctaattttttgtatttttagtagagacggagtttcaccgtgttcgccagaatggtcttgatctgacctcatgatccgcccgcctcagcctcccaaagtgctgggattacaggcatgagccaacaccccccacccttaatatacattttttacaaaaataggacaggccaaacaaaccctttgaattttccaatttaattagccacaatcacaattttaatttgtaataccagaaagcacaaatactatgctcctgagcaattttagagcatttgaagagaaagcaaaaatctcgttttaaagatattttaagccaagctcatggatcttcctttcttttaagcagacatagactagttttagttgttaggcttcttcaaaagaaccatatccaaaaagaagctttaccttgggtatggacaagttagaagggtctgtaaaggagatctcatcccactcattcattttgcaaataaaaacagttgtcatagaaataaagtgacctgtcaggccatgtggccaatactgttagaacccaggtcttctcattttaattcacattctttttatgtctctgtccttggtcttttatggaaactccccttatgtaaaaacatagatggcattaacagccttatcattttcacagattatagtactatcttttcagtgttggtaaggttggggcaccctggaaacaacttaggtctctcatttcttccgtttcattagtattcatctctcaaatgattctctacatattccgtcatgatctaaaatgaatagcttataaaaactaaaatatattcaaagcaaaatttatttttcaggtaaaatgacttgagatttaaatgctttgtaaaaatgctccaaattttctttaaaagcaggcaatatttttaaatcaacttttatgttgcttccatttcctgtttaactctatgcttaaaaattaaaagaaagtgacacattagaggaattatttagctaatacaagcaaaattatttattggaggagatttgtttttgacagctatttatatttttaattttaaagttttcagatattacaattgtttatttcattttgcatgttttgggattatggtaacatccttttgaaaaaaaaaatttgttgcataagaaatatatcaactacagaatatatcaactacagaaaacttatgaaatataaagtggtcaaataaatataaataatacttaagaaaaactgtcataattccaacacccacaaataattaccataaggtttccttcaccaaaaattttatagcactatttcagagctattgtaataaattttctttataggagaaaatatatcattgtctgtaatatttggatttggtttttatatgtttcaagctaaatttgtaaagtcagatactaaggcactttattgtcattttctggacaactgttgtgtccttcaaatagttatgttcaatgccacaaattcctagaggaaactgcaattttttattttttattttatgtacagattggagaagacttccaagagagatgatgccaagaaataaatgtaaaaaaggtacattgactaatataatagtaattcaggtaggaaaaggttatttcttacattctgttaatatggatttgtcaacccaaagttatactcactgttcttaatgcttttcttattttgagccagacaagggatctcatgcctgtaatctcagcatttcgggaggctgaggtgggaggatcacttgagcccaggagtttgagaccagcctgggcaacatagtgagaacttgtctctacaaaaagttaaaacaagtattagccaagtgtggtggcatgcacctgtagtcccagctacttgggggtctaaggtgggaggatcacttgagccaaagaggcagaggctgcaattagcctaaactgcaccactgcacttaagcctggaagacagagcaagaccctgacactctgtctaggacactgactctctccctctctctgtccccccatgtatgtgtgtgtgtgtgtatatatatgcattataactattttgctaaagcttgttttttgttgtttgtcttttgggtgttttttttcttagttgttgccttttctttgtgtatgtcttattttttaatttttaaatgttttatctttttttaaatttctgtgtttattttagatacaggggtacatgtgcaggtttgttacattggtatattgcactcaggtagtgagtgtactacctaataggtagtttgttaactcactccaccccgtcctcccctcccgactttagtagttcactgtgtctgttgttcccatgtttatgtccatgtgtgctcagtgtttagcgcccacttataagtgagaacatgcaatatttggttttctgttcctgcatttattcacttaggattttcctttagttatggaattgtggagctgctaagaaagacttttcaattattgtagaccttttcatttgcataactgcagattttttattatactggctacattataaattattaactaaaacattttaaaattgggaaaccaataaaatggagctttatgttgtatagaagaatgccaaagtgaatgtttacagtttgtttttctttagtaatttcattcagtaaatagttatctattattgccagacattgtgctgacaggaataaaactgagcaaagtgggaataatccttgtcctcatggagcttgtagtcaaatggggtaaaatcactaaagaaaaacacactgtcctcattgggaagggttctttgaggacatggaattggagttgagattgaaggatgaataggagtttactgagacatagttgtgggagaggaagtagggaaataccaggtttgtgagagaaaatcagaagttcagttcaaagatgttacttatggttcctttgaaatatacaaatataaatgttaaatatattcttggatacaggggaatggacctcaaaatggagatagcagtcattatcagagatatgatcattgagaccaagagaaaggatgagatggtctagggcagaattagataattagaagaaaggagagcctaaccctgagcttacaggaatgccaacatttaatgggctggtagaggagattgaatggcaaagaagggaactggaaagagagagggaggaggagaaccaggagagcagagttacacaaggtagtctggtatttcggaaggtggtcaacaatgttaaaagatgttagacattgctgctaagaggtcagataggacgaagactggaaaatgttcactcgtttttgacatgttggttattgtgacctcagtgagagctttttgaaagattcactgaggtagaatccagattggaatggcttaaccggtaaatggagcttaggaaatggagacagctagcatagatgagtcttcttagaattttgctatgaagaatgaagagtgaaaaaggaaggtagtcagagaggttaagaacagtggggttatcaactaagagaagagaagagaaggaattcctattccccgttttaacacctttattgagatataattgacatacaatacaatgcacatatttgaagtacatacacaatttacattttttgcacatgtgtatttaaggcagagtatttttattttattttaaagatacagtatataatcatatttagcttgcataaagaatattttgaaatatgacaatttatcttctgtcttttataccgttggtttttattgggcaaatatattattttcataataaaatacatgtgcatgaatgatactggtcatgtcctagaggatcacacatctgtagttgactttaaagctgagaaaaatgtgttcattttggaagagttaatgttttcaaatatgttatccctgggattttatacccacattaatcagtaaaagctcccaaagtgtcaggatttccatttgttaataaacaaagcaacaatgaaactttctcattttgctctagtattttttattacatattgtgtaatttttatgtcttgtttctgataagcttgtactgtcctttatgttaagatgtcctccattaatttacatggaagtaaacagtaacaacagagtcaaaggctgaaaacagttgtttcttgaagaaccagctactgccatgtgttaaaagaaactattcaaatatatgcagatacttggccaaagatggaaaaaaaaaataagtttacttacctggccatattctctagtatcccttcaacaaaggtttatgttatgaaattaaataatttgataaaaagttcttagaaaaagacttcatgatgtaagtagaatacattcttagctaatgttttttggcattaatattataataatttattgagatcttgttcatatgtgatgctatattttatgtgttacagttcatattaaacagtctttgccctcgagggggtcagagaaagttacccatcattaaatctaactattacttttgtttgagaaacctcactaatacatatgtttgggagctctgagctcagtaattccccaaggggcaattcagtataacacagtaaattgtaattccatcagttatgggtcatctaccacaatctaaaaattttcttttgtaggttaaatgttaatctttaacaaaattacatctttctgagccacattttcctcttacaaagtaatttctaagtgtttagctttattttggaaaagagctgtaatactctttgaccacaatgggacaattttgtagcctatcatattgcttcggtaactgactggcagaatttatatgtgaaatacttctctagaccctgcactttcagaatagcctcaaaatgcaatatttttgataggagtaaaaaaaataattatgtagcccaaagccattacaacattttatttcacttacatgcttttgagttttcagattcatatgatgagtatattcagtttattttaatctttattccaaagatacttctgtgttgcactgtcatctctttcaccattggtaaatgaacatatttgaagtacagacactttacattttttgcacatatatatttaaggcagaagtatttttattttattttaaagatacagtatataatcataattagcttgaatgcagaattttgagatatggcagtttatcttctgtcttttataccattggtttttattgggcaaatattttcataataaaatacatgtgcatgaatgataccagtcatgtcctagaggatcacaaatctgtagttgactttaaagctgaaaggaatatttatcctgcacttcctttttattttacacacctgctaagattcctctggttaaaatgaagtacacttaccagtgaaggagaagccagtgcaggtggatttgtgggagcctttcactatactcttggtacttctctatctgaggcaacattttagcagttttggccctaatgatattaattgccagtaccaatgttcagaactagtaaaaaatatagttaacttcagtcttaaaaaaaaaaatcctactacgtgattatcatttattcatcatcattggaaaattggtgaggtatgatttgtttattctttgagaaaattaatttactctgaaaactatgtgactgcctaggatgcagtagcacgatgctggacagcatacgcaaagacaaggaaatataatacagagttgcagttgcagaaaaatgtgttaactggtagttttacttcagcaggcccaaaacccaaaaaggcaaaagacgcaggcaaaggcacaccactcactaatactgaagatgtgttgaaaaaaatggaggtaaggttttcttcttactatacaagtgaactgaaaaaatgtaaaagatcctacctcgttttgctctgtttcaacctttcagcattctcttactttttaataatgtaaatttggcagaagcgagcccaacatataaggtaactgggaaggtttgaactttgcaggctgggagatatggagggtctgtcctgtccttcgttaccactcacctggccacttacctcaccttctgtcacctctttctttttcactgtatccccctttccgcttatatttgaatcatgcaggcagagagaaacatgaacaagttttaaaaagagttacatatgtaactcttttaaaaacctctcatttttcctcctgttggttaatatgtacagttttaatgctttttttttggtcttaagtattgaagactcttgagggaaaaatgtattttatagaacttatttttatagctttctttatctaaatatttcaaaaataaaaaaatgtagattcagaaggttaaagcactgaaaattttaaaaatttaatttttcaaaaataaaaaatgtaagattcagaagtttaaaacactgaaaattttccctcctattcctgtccctagtcatccagttcccttcctatagacaaccaatgttactagtttcttatgtcttttttcagaagtatttcatacatagcaaatacgaggtttctttttctttttaaagacagagatagcatattacattctgcgttttcattttatcacttaactgaataccttggatgtggttccatataagtctgtgtagagttacctcatccttctttttttttttttggctgcactataaaaatgaactgtaatttatttaattaatatcctacataattggatatatggacattatgtttcatctagtgttttgctgttattaacaatgctgcaatgaattcatgttaagtatgtcatttcacctgtgtagggtagatttctagaagtatttggtcagtacataaatgtgcactgtatgaaatggatagctattgttacattgctctttatggaggttataccaatttactaccgttatcaatgcatgcattgtcttgccttggtgatgatgatgatgacagtaacagctaacactttattgaaacttattctgtgccagcctccttgatgagctctttacatatgttatgtccataagagttcataacaacaaggagaggtggatattattccttctttacagatgaggaagtcaaggctttaaaatttttacttgcctggccaagttggcacagctatttggtagtggaaactcatatttttattttattatttgaccagtactggagttagagacaacatgtctgaaaaataaagccagagtactgatgaaggagcagtgataactgtcaggtttaactatggcggaatgatgggaatgcagttctagccagtttgtattgactgaactcaggttctggctattctaaaagcttcctggagaaaacttgctaagatgacatgtgccgtaaggaagattgatctggacctctgggtttctccgtgtaacaaactgtgtttccatattgtctacatttaaacacaattttcaggacacacactggaaaaactggaaatttaaatctagaaataccaatgagtttagaagagcaaaagttgttcccagatgactttcttattgctgattttttcagcaaaagcagttccaagttttttttataatagagcattcgtggatggagagggagtgacatacattcaaatctcatgattaatgtgtgagtaattagtggtaaactaatatctgaggtttcttatttctgcataacaggaggctctgtatggtggctgtaaggctgtataatatttaaaccagaagaactgctctctgtccataattgaacactgttttcagtatctttatattattcattttattcttaaatctgtaaagtagtaaagttagatggttaaatctcaacaggagagaaaatggagactagtaagtagaagagctgaaactagtagcttaatgcaaaaggaatgaagcaatgagacaatatatgtggctttgagatcaatttttattaaaaagttgcataaatctacttttaacctattttatgagtctgatttagatctgtgtggtggaaataaagatgaggatttttttttttaaaggtatttgaggtagcaataatagaaatagagacttcctggttcctatgtggcactgaatgaatactgtatttaaaaagtacttttggccaggcgccgtggctcacgcctgtaatctcagcactttgggaggccgaggcgggtggatcatgaggtcaggagatcgagaccatcctggctaacacagtgaaaccccatctctactaaaaattcaaaaaaaattagctgggcgtggtagcaggcgcctgtagtcccagttactcgggaggctgaggcaggagaatgatgtgaacctgggaggtggagcttgcagtgagccgagatcgtaccactgccctccagcctgggtgacagagcaagactcccatctcaaaaaaaaaaaaagtacttttacataactggtttaaataactgtgttcttaattataaaaataaaataatagcatgttttttagatatagtgtgtaccctgcacagagctaaataaatatggcactacaatttcctattaactatacaacttattggttgcaggtctttttactgtgatctgattaaaatagtaaaaaaatataatattaacataccatcaaatatgtgtgtgtatatcttattatagatgctgcaaaagatccataagcacgattttctttacttgcacttttccaaagggattgccagttggaaaaattgcacacatcatattgtagtaataactcatataagacaacatatgagtcagtatcaagataaatcatcttatgtctgttaccttggtcttatttgttctgcctgagtgggttaagcagacaggaaaggtggagtttgaattttgattagaaattgagcctatctaatgtagtctctctgttgtctttgatttccttaaattcaaatttgaatttaattacaaggatttttaaagataagcgtttaagaaccagtaaaggaatagctaagttgtagttactccagatataaaatctgctttctctctatatgtaatctacaaagcaaataccttataatagagatggagtgtttgcagattcatgcattagtattccaatttctgtttaggaataatcacattttagctgaggtgacttatgccttaattatgcgtattaatatgtgaaattattgactcctggaaaacttgtgaaattctatcatatgtgcaaattgagcatagtacaatttagtgaacagatagtgacagtaatgaaaataagtcactttttattaaatgaaaaaaattgttggtagtcataatagaaatacaaagatgtaattttaaagttaattttgtgtactattccctgatggttccacttgtggataagtgggactctcatggaatcaaagctttcctaactctgcatctctcttttgtcttctcttttagaattcctaataattgctagtattgactgtgatttgagttttaatttctctctttcttctcaatctgccagatatattaagaaacaagaattcctggcaacaggaagtaaataatgagagagaaaaaagataaagacacagataaaatgcaactaggataatctaacccaggatgacttgctattataataatagtattaaatggcctcatgtataaagtgaaacatagacattttgagataatactattaccttatttttccccttttatgttagaaggaaaacaaaataacattctaaaagttctccataaactaagtcacctcaaatattttagaaggaggtaagatagaccaccaggtactgtggctcatgcctgtaatcccagcactttgggaggctaaggtgggcagatctcttgagaccagcagtttgagaccagcatagccaacatggagaaaccctgtctctactaaaaaaattagccaggcttggtggtatgcacctgtagtcccagctacgcaggaagctcaagcaggagaatcacttgaacccaggagaaggaggttgctgtgagccgagatcgtggcactgcactccagcctgggtgacagagcgagactttctctcaaaaaagaaggtaggagataaattataaaaaataaagcattgtgcattagagctgataagcccaatattaatctgaaacccaattattaagtaacaaaatcaaagaaaatgctggtttagtggtgagacagtaaattccttctttcttgagttgactcatagtttcctaggtggtagccaggaggtggtggtaagatgggagtagaataaggtgatagataactgttcccttaaggctaagcagggaagtcagcagtctagtggtttccatacaaattaatgaaactcacttataccaggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggtaatggttcatttggggatggtagcaaaattaataaggtttatctaataaggaatcagatatagagtatgtattgaaatcaataaacagaaaccaagatgatgggaaccagaagtatattattatcaatggcatcgattccttgctatcaagagaacttccttgctatcgagagaactattatagcattgaaattataatgatgtcaaattgaatataggaaataaaaatgattggcaactttgtaagtataaatctgcaagttaaggagattgatcagattagtgcagttaagatttaacaacataaaaatttaagtcagcaattcaggtaacggagggcttaaccacctaggtctagaggagaatccctgcagtgtgtttcaaattccaaagtgcatgtggatactatcagagaagattgataatttaacctcaggtatctggctgagtcaggactctgtgttttccatttgggatgtctaacttttagaatgaaatgcacatagtacatttcagaattagctggagtcaatcaggtatttttagtagggtaactttgcagaccacagcctcttcgggactttgtagacacctcagaccgtaaccctaggtggagagtttcttctccattctggtgacctttgtcttcattccatttcagcctcttataccacattctcaaattttgcttctctggaaacttccaactatgaaatctttactataattattttgcattaaatttggtattcttttgaaatttgtattagtataaacagagaagtgtggatacattttttatctgtttccaagtggctagccagctgctaacctcatttcttaatttgctttcctcgttgattttgaaattcttctggtatcagctattagattctcatttctacttctgttctctgttccattgatctattttgaaccaacactaagctgttgcaagtagtagaagcttctgattatttgttaatgttggtagggtatgtcttccttcctattcttttttcacaattttcctgaatattctgtctattctttcagatacattttaagtctaaacatttaaaaattaaatatgtcacatttgtggtagatcacatttgtctccagccttcttttcagatcattcatgtttttatttccattgctctctgacatgattgaaactgtcagtacttctgatcatctctttcccctttattggttctctgttttaattttcttttctaagaaacttagacccttgctcgcccttcatcttcttttttgccattattgtctcttgtcctcccagcgcacacactagaccaaagccaactttgatcatttccattctctacctattttccctttcaaatctgacctattgagcatttcttgggaatcacagaaattgatgcccctcaaaaaacactagccccattttgctggataacatgttttctgtttttaagtcagctctctacagcaattatttttgatcaacttctttcttcttatttccctttgtttactaccttttctttcactcttagcaggtgataataccttcatacgggaaatgaagtcatcaagaggaaactctattaaatttcatgtcctctgccttcaaactcagtgtcttccttcctcctcctctttttttttttaatcaagggaggaaatcccctttatcctatttggggctaacggccctatccttttttggaaccatagtcctccagtcatttccctttccatatttttaacctctttttctgcttgtctcttccattcatgaatgttcatttcccattgtaaaacatgttcatttcccattgtaaaatatgttgtccacattctccctcatgccatctcttgaaaagcttctttagctgtcatcacccctccccctcccccaccattagctcttttcaatcttagtttcacctccatcctattcaaataattgcttttgacaaatagaagtagcttaaagaaagaaattattgctaccacgctcaccatagacaaattttagcctttatgtcacttaacttttttgcagcatttaacacttctgacagctctattattaaaatattatttcctggccaagcgcagtggctcactctgtaatcccagcactttgggaggccaaggcgggtggatcacgaggtcaggagttcaagacaagccttgccaacatggtgaaaccctgtctctactagaaataaaaaattagccaggcgtggtggcgggtgcctgtaatcccaactacttgggaggctgaggcaggagaatcacttgaacccagaaagcagaggtcgcagtgagctgagatcgtgccactgcactccagcctgggcaacatatatatatttatgatttcctttatttaaattcaacaatttacagcaattatatgcatcttctatatgccaggcattgtgctaattgccaagtcttagacaaacatggttgcttcccttaatttttgttacataatgcttttcgtttttctcctatttctggtacatttttatggtctctggagttctttctagtctttaaatgtcagtattcttcagggctcttccctcgggcttctttttcttgctgtaatctctctgattgcatccctccccatagttaccctgtataaacatgtaactcctcagttctttttcattcaacctatagtaagtgtacactaagtatatgcttggaattgtactaggcaatgggaatatgaagataagatacagttcttctctcagggaaattactagagagacaaaaaaggtaacagttaatatacagtgaataatgctgtgatacagtagtaccggatgctatagcggcatataagagatgctgtgggcacaccaaagtctattttaggcatatcaaagatgatatttcaaagaagacaatttaggtgatctgaagagctaatcagatcaagataggaacatggaatggagtggacacttgcagggagaaaaaagaacatggagagaggcttgcaggtgatgggagtgtagcttcttaatttaactgaccagataaatcggtatggcgggactagagggtgttaagtgggcttgtgttgagagatgaagctggagagatgagcaggtcattaaggactttgaatgtcaagctgagaaatttgactttatcctgagtactgtggggagcattgaggggttttaaacagtggaatggtataatcatgtttatattttagaaagctcagttgctttgaatggaagagccaagtttgggtcatatttgaaagcttattgctgtaaaccagtggttttcaatactcttgaaaggatatttggtagtgtctggagatatatttggttgtcacactgccatgggggtagtagggtggtggtgctataggttctagtttgtgtggtcaatactctagacaagactggcatttgcaatgctctgttgacaatgtctgcttgcactgagttcaggatcaagaccatcctggctaacacggtgaaaccccgtctctactaaaaatacaaaaaattagccgggcgtggtggcaggcgcctgtagtcccggctactcgggaggctgaggcaggagaatggcgtgaaccagggaggcagagctttcagtgagccgagatcgcgccactgcactccagcctgggtgacaagagtgagactgcgtctcaaagaaaaaaaaaaaagattactaacgtcacacaattaccaaatttgaatcacttaaacagaacttggaggaggtactcatgtctaaaacacaagtgacatatgcttgatttggaatactagagtatcccttccttattcatctccactttatgtacaaatcggcttacttttatttctacacaagtgttcttgccaaaggtctcctttacaatgagacctcatttgaactctcaaccatgccaccctcccctggtacacaggccccaagcttcacccaggtgtctaaatattgccaaatttttttggcaccagaaaagccaggccaactttccagagatgggaatggtcttagctgaatgcagaaacttaaagtatctagggaagaaaaagtaatgagataactatctaaagaatgcatatacagtgaataatgcatgttacctttcttgcattatgtaaatatattaaaaatcccactatccagatttaaaaaaaaaaaaaaactttggaaaaaaattagtaaaattgataggagactttcttttgagagtagtctgtatttcttactatagatagtagagatgtggacattaatttcttattatagcagatctcaatcatgtgcaaaaatgtagtgactagtaaaagaaacacccatggtcttatcactcagctttaacaatggtcaattcatagctaatctttcaaccactcattcatctacccaatccctccctgtccacccatcccattccccgtgccccatgtgccttggattccaaagaaaatcctaggcatcgtatcatttcatccacaaatatgtcagtatggattcaaaaataagggctctttaacaacatcactgtatcattataacaccccatacaatgaaatataattccttaatttcatcaaatatctggccagtattgaattttcttggttgtctcaaaaagtttgtttgttccaaacagaatccaaatacaatccatacattgcaactgattaataactcttaggtttaatttatatccaaagtggatttttgattgtaagatactggaggcccggaaaaataaataagaaagtaatatttgaatttttgatagaaagcacagatattttctgagttatttgcatggatgatagtcttattcagccacaagaaaaagaaactaagaggtcctagatagaatataatataggcatcttttggatttggtttggtatcatgcctttttttttttttttaataggaagtaaaagtctttctggcttatgcttagttatgttttatgactaaaaatctcagtactggtgtagtctaatggatgttaatgtaaactggctttttttcttgtctgtgcattttttgggtaagtgtttagtggtttagctaactaaactatgtatcatcccagtaagctgtaatgtgttagtagctatattatcctattgagatggtatgggcaacccttcatgttctcttagctagttagtgcctgacaagagtggaaggtggtggtcttaaggaagaaagcggcacaggtaaacacaagtgaaaactgttgtgtttttgaagcagataaaaagcagagacttttaggcctggaatattttcttactactcattcattttaacgtttacaaaggaatatatcatttcacttaggaaaatgactacattaattcatactttgaagatggagatgattttggcgcagacagtgatgacaacatggatgaggcaacctattaggcatgaaatttttcaaaaaatatttttatgatgcagcttctgaacatttggacagacttgatttgtattttatttctgataaggaataagtacttgtttctgttgttttggacaaatagttgttaccaaaatattcaaaaccactttgagtttacatactagttaccttaaaaattattccctgacactctgacattccttctaaacacctctgccatctctcttatgtactctcatgggtttttttgtatgatttgaatatgaatgtgcctaaagaatttttgctctcttaatctatgtatacatacttgaacaaatcattcttgcttaactgctgatcttttgtaaaactattgctagtcataatggatttctataacctgaaagttgatataatacagcacgtggagcactttaaaaacaaagaaacttgaaaataattttattttttacctttacatggtgtgttctagactactgcattatgactacataaacctacctgagctcttacaagtacagaattgtgagacagaggttttgtgatggaaaacatacacatagggaaaaataccaaactgagcaatataaatttcacagctcacatcttagccagtacaaagaaactttcacatggggtgaatattataatacttgaatttgagacttaatactgtatatgaattaatcatcccactgtaataactgacatcttcaaatagttgggcttatgaaaaatttgactaagacattttattttatactttatgtaaatgtgaaataagttctggtcatataaatatgtagaatgcatgtgtgtgaactctatgaagtgaagtgtggtggccttttatgtttcagagtactcaagtgtacaattgatttatataaaaatgcaaaatgaactcaggtcattttgaaattaatattaatatttttgttgtttaactttaaagctagctcccctaactttatatattttttgggaaaaaatacctaaaaacctcagcctacaaagactctcagaaatgccaaagattttcaaggaaattcatattatatatttcaaaaatgatttatcaatgttatctaccaaaagaaataattttatttttcccctttggggagatattatcctctaatatgagaatcagatccctagattctatttctacctatactattaaactcaaccttgaacctgagcttggttgtttctgtgccttagtttctccactcgtaaacaatttcctataaaaattgtttaaacaccaaccaaaatttaccatatgtattcattctcttgccttaaagatcacttcttaacttacatttggctctcaccctctaaaaatttgtagtttggagagtaactgaaagcacaattttaagaaacatgttttcctcacaaaatatattgtaatctgattttcctatcttgtattcatgcagaaaattggagaaaatgtgtattgtcttgtgccattctgcaatatgaatttctcaggaaaaagatgtttcaatggcaatactttcttaaataattcaagatgggtgtgaggacctatcttattagtttagtgctgtgttaaccatttgtgaattacttcttgtttaaaggaagttgtcaaaaaattttaagattctaaatggaatacacgaataaagtaagccttagaatagaaacctcacaaaaagttgtcatttgcggttgataattaacataggtgttttattctctcaactccttagtaccagagccaaatacaatttagttttcagaaatcttatcaatattgttctatttacctacttataaatctgcagataaccacttgaaccaggcaaatacactgaagataaaggttatttctttttttagctttgaatttgtcatgaccattttagtcttgcagatagcagggcagccccttggggcaaggatttactctgggaggtaccgttaagagccttctttccccctttgaaagatccttttacaatgttaaagtatactagttgcaagaacaagcaggatttgcaggttgctttaccagcatgagtctcatttttctggcttaaaatctgggactgtgaaattattccataggaaagtgaatgttattttgcagaattagcctcttacataaaagtatttgttgaagtgtctttaaaattgctatcatgagcaaaactggttgctgtaatgcttgtttttctgtatttatttacacattaaattcttacaaaacaaaatgtgttcgtttgttttatagtaagatgttttattttgaacttatttaaatgtttatttgttagagaaaactaatttgttaatatagatcttaactagtaactattaagcagggatgtttgttccaaatattcttgaataaacaatcaccacaaacaacaaaactctggttaatgattattcaaaaaagttgttgtgagatgggcatgctggtctgtgcctatagtcccagctactcgggaggctgaggttggagaattatttgagctcaggaggtcaaggcttcaatgggccaagaggaggctgaggtgggaggactgcttgagcccaggaggtcgaggcttcagtgagccaagatggcaacacacacacacacacacacacgagttatgataacttaagagatttggcagacaatataatttagtgtgatcattcatgcttgggctgacttatagtggataccagagaatgttaagacattcagaagattctttttaaacttttcacttcactaccttcaaatgtacagtgtcgatggctttgcctttacatggttaaaatctcaagcccgtgtggtggcatgtgcctgtagtcccggctacttgggaggctcacatgggaggatcagttggccccaggagttcgaggctgcagtgaaccatcatgctattgcactccagcctgggcaacagagcaagagcctgtctccaaaaaaaaatttaaaaaaacctctgtagtaaaaattactatttattaaaaaaaattaacacaatattaagatcaagatgcatttgaaaatggaagaaaaaaatcagggtttatacacattcctccattaaataaataaaagctccaaagaactttctcaatttttctgctaataatcttttaaacagtattcttgaggttgttttataataaattaaaatcacatataaagagagcaggttataatctatagataatgactcatctacaacttcatagcaattcctggaccatgccttaccagatcttaccctgaggaaaatctcccaaagaacattcatctaaaatatttcatctatgtcttacaaataatccaaggtattctgcttcactgtagcaaataagaaatctgaattggtaaacctttggcaatctgctctatcttacataatatctctatattagatagtttgaaagtggagaaaagctttgctttattcaattaaattcactggcttccattttagattgaataagagaaactttattacatgttggagatctttcaaaatatgaaaaataaggggcaaaaaattttaaaaactggttttacagatacacatgctaacaatgttctacagttacatttgtataaaatacattatacaaaagatttatagattttgcatacataaaaattaaagcattcagatatttctatgatctaacagtgcaatatgcacatacgtggaagaaaatactgattacctgagcaacatttttgtaatgcaaattaaaaatgaatccatcagtgcaccatttaaatacagactttaaaaaactccacctttaccctgtaacactgactagatccttgcttcatgatatttctaaaactaagcatatccttcatattttcaactaggtaattttagaagtagatactttaaaaaagaactaattactaagtagtggttcatttaaataactcttcaggacactgaaccaagcaggtagagtccaggaaaagaaaagctgtaaataaaaagtcctttggaggagataatttaacatgagtcttctaatttttaatgtggccagcagagtgtgtaaccatttttaacatatcttttgaaaatatgaactccataacttcctaggagtgagatagcaaagaaattttattttaaccgagacttcataaaactatcagctttttgtttacttgctaactccaaaattttaagtaaaccaaatgcaatgattctgctgttacttttacattgcatacaagtacatgcgtgcacacatgcagacacacacacagacacacatgtaaagcaacaaattcaaagaagggtgtcaacacaattaaaatccataatgttaaacaataactgtgcttgttagttatacaaggtaatttgcatttgatataaacttaacttacattagtactttttagaaactaaaattattccaaatgtattaaatgcttagaaaattcatttctttcctaaacagattagaaccataattcaatatgtaacctttatatagaattatatgtaactcaaattatattcaattaattcaaatatataatttaaatacagaaaaaagaaaactacctgatgtgttataaggatgtatatttccttcaaaaaaggatactctgcaagacaaatgatttttaatcaacaaatacacagcacaccttattcctttaaaaaataagttacatattttggaaatcgaacccataacaatttcaaagtacaactagcaaaaaaagtaaggaatcactgactgtaatttcatcaatttgatgtaaacaaagttcttcaaaggacacctggcctgtttaccctaaaataatctgcattttcttccttaaaacctcatttttcagcagacttaataaatacaatgtaaaatgaccagttaacactaagcataaattatatcacactcttcttttcaagatgcccaaggcacattaaaactactttttaaatgtttaatttactaagagaatcatttgcaacttccctattaaacactttttggtaattgtctaaggtcctctaatatttgcaagggctttaatgtttgacttctttgtcctgtcttttcctgatggtcttctcctgaaagtacataaaactgcatttgccataaatatttacttattctgagttaaatttgaaatatataaaatgacttatcaaaagcctgaaacatcaacaattaggaaataatgcccagaaaatgaggtggtattatatatcttaagtatatattatatacaaaacaggcaatccagactccaccaaatctcatttctattgaagaatcattctggttacatttttaaaacacatacttttaaagattaaatgatggaatcagtatgcaaatgcttcttacttagccagactgtagccgactcaacagatcttaaaaagaggcactaccaccccctttcaagcaatctatacacctttggcctttgtttcccaatttgatgctatatatagagatcaggaaaaaagtctaaattggatattttctctttgaaaaacagaggttaagggattactaaataatttgtctgttactgctaatataaaatacctctactcttttttgcttaatgaaccattttcttcaacagacctcaaaggcagttttgacccaattatttgtgcttgatggtgaaaatggagacaaatttatatagcctatgtaacgaatctgattggaccatatgaaataatgcttatttttaattctgaaacttggatttacttacataaagcagtaaggcattaaatgtaattaaggcatgttactgtatgtaacagcaatgatttatcacagtatataaggaattatttcctaaataatggtaatatgcacgtttaatatatttttcatcatcaaaactacaaaagtgctttcaaatatcagaggcaaatataatcattttaaaaacagatgcacagaggtgaggttaaagggtctgtcctaaagaaagcattcttaagacaaaaattactgtcaggtcttcacctattccagtgttctactgacttcccaaccataatacattattttggggtcttgaaaatattttaatctatttcttggcctctgttgtaggaattataaatcactttcccctttctctttgtacgtatgctttcatagcacatgtgctaaatgtattttttaaaagttttgaaggggtgtgttacgtatcctaccatgaataattttagaatcaaattttcttgcaactgaatattttgggggttcatagtagtaaatttttttcagctgcagacatctgatgctatcattctgcatcataaatttaacattaataaactttttaaaaattacttaaaaaaataaaatttaaacatgcattttaagaaaaatgatacatcttccaagttaagtacttcctaaacacacatttaaattaatttctgcttgaaacattcacacaccagatttatggatcaactgctctcaacatcaacaactagttgctcaaaaaattttcaaagtgtgaaacccttttgttaaaaacaaaagcatcctcaatctctctaaattctgcctttgaagctattattggatataactgattcaccacattccagatgcacatgtgaccactaacatttgattatgagctaattgctatgtttcctgttgagcagcaggtgactgagaatcttgactatacagtttatgatcatcttgttggctgaaatgtattcctttagttggcacaattccattttccatttctctctgctgtgatgggggtgtgatttttgaatgtaaatgtgaagagtccactgttgaatgatgactaacatccaccttagctaaaatttcataatacaacaaataaaacactggtgttattatacctactatcaacattatcactacagctgtccaccaccctattccccagtctgctccataataggggtctttacgttgagtgtttttgttatcaggttcaaaacgcatttgttgtgctgttaaggccgatactacctcattgaggttctctctcttattgtctgtacactttactatttgttctatgtctcggtctacttcttttaaaaagctaccagctgagtcactgtaagcaagagaatcattagctggcaaaatttcctgttgttcggaagagtattgaacagatgaatgacgtgaagtctgtcttccttttggaggacaaagtgtttcggtcaaggaactgaacttttttactggaattttgatagacctaagggcaaaaaagtcttgatcactgatgagattgttaactctcttgatatctgctacctgtgggggggaaaaaaaagcaacatacaactgaattccaatcaaaataaaggcagcaatagtcattcattctagttacttttggaggaaaaaaaaagttgaattattagtagtattaagttgcacccagagaaattttaattttatttgtagatgagaattctacaccactttagatgtaccaatcttaggaaatcaccaactactttttactatcacccatatatgttagtaacactaattaatgctatttaagtagattctagaatcctttgctgcttccctttgtgcatcatgcataaataccacagtccttctgcttgtaaacaatttgtgaaggaaggattatgggtagttatgttctttattccagtttggaaactggaatatagacaaatgctacccaactaaaactaccatattttatcaaaactaagatgccataactctaagatgcagtattattttatgtatatctagggaaaaaaaaaacttcaccaaaaattgaagatgccaccattccaaaaaaagatgctaaaatgtgtggaaaagcatatataccttagaatttaaaaaattggtaatttatcccccttatttctgaagccatttccctcccaaacttctcagtgtaaatgcattattcaactactttcaagattaatcacttttataagctttttctctatatattatacattcctcaacctgtttgtattatcccatccactgtgagataacctgtctgtatatcctattccactgtgttgggggaagaggggagtgtctggcagattaccaattggtatgccaggctctcccaccatctattagtcccattcatttccatcaatactttaaaacctaatcatgtatcacctgattcatgtcagagagataaagtgggtctagtatgaagcttagatttctggtttggtcaacttgatggacgatggcattcattgagaaatggaacactgtggagggtaaaaagaggctaaatgcagattttagatatgctgacttggagctgcttgagatacagaagtggaagatgttcaggacagagttgtagatatatgtctgaaactcaagaacgatctcggctagagacacagatttatggactatcagcaaaaatgtaattgaagtcagccagacgtggtggctcatgcctgtaatcccagcactttgggaggccgaggcaggtagatcacctgaggtcaggagttcaagaccagtgtggccaacaggtgaaaccccatctctactaaaaatacaaaaattagccaggcatggtggtgcatgcctgtagtcccagctactccggaggctgaggcaggagaattactggaagccgggaggtggtggttacagtgagcagagattgtgccactgcactccagcctgggcaacagagcgagactccatctcaaaaaaaaaaaaagtaattgaagtcaaagaggtcaaagagtagagagattcactagaaaaagcctgagagaaaaaagcaacaagatcatccctgaagaactccaacatttgatgggtatgctgagtaacaaaaatccacaaaggagattacgaatggccaggaagggaatatacaatagtggttaaaagcatggataactgggtttgaggcatggctttgacactttctagctgtatgacctggggcaagttgtttaacctctttgccattaaggttccacacctgcaatatggcagtaataatactacctacattatagggttgaggtgaacattaatgatttaaatgttgtaggacactcagaacagtgatttatggtatgtcatataaaagttagctattattaaatgttaatagtaggaaaaccagaaacctgaaaagtcaaggtggtcaagcagagagggtctttagcagggagtagtgaacagaatccactgtagattcgtgatcaagtacaatgaagactaaaagaggtcaagctggaaaaactatcttgcaatgtatgtgtggggggattggaaggaaagggttgaacaataactaaaagatgaaacagtaaagataaagtgtgttttatcatcttactaccttcgcactgttttgtcttatagcaaatgaagattcactgaaaaatcccagtctgaccccattctctttaaatgctcttttgcttggtattgtgtactcttactaataactacttaatactctttttgaattagggttccaaggtttagtatctacctaagttatctccctgaatatccctataatgacttctatgctatgccaacttccttggttgcattcaagattccaaccttggactttttattcttctcatcacagttgtataactgacagatttttaataattcttaagattatttctaagtggaatataccactagctacttactgtattttttaaatgatagatccttttataatgataaatatttttataattttttttgttgcttatgcttccatcaaaaaggagcactgcttatcttaactaattctgttcatccctttcccactatagtggctgatatgtccccacccaaatctcatgtcatcttgtaatctccaatgttaggggtggggcctgggggaggtgattggatcatggaggtagatttcccccttgatactgtcctgagttcttgtgagatctgattgtttaaaagtgtgtggaacctcctccctcactcgctcttcttcctgctccagccatgtgaaaatgcctgctctggctttgccttctgccgttaagtaaaagctctctgaggcctccccagaagtagatgctgcctgcttatgtacaacctgcagaaccatgagccaattaaacctcttttcttataaactacccagtctcaggtatttctttatagcaatgtgaacacagactaatacagtggccaatgccatctctccatttaagtacttttcatcattctcatttcacataagcattcagctgatatatcctgtgatttcccccaatacattaacacttcttctctatccttatcacaaatattttagtctaagtcctgatcatctttattattccagtaatctctttattggatccccttcaattcatcagcaggcccctctgctattctgtatcactcctgttaaaactctacaataattgtattctcttactatatggatcaaacttttccattctgtatcactcctgttaaaaccttacaatatttgttctcttactgtatggatcaaacttttccatagtgtctcaaagcatttcatcccaaatagtctgtgccactcacttcggaaataactatgaaaattccctttgttgtttaccatatttcctccttgaaatcttcttcacatcactgttgaatgcctgaaacatctttacacctcattggaaatatgacctatttttaattattcagatggtatgttaaatttccctaagaaaattttctaggttcattaaaagaaagctaatgtcttataaaactactgaatcacaaactctcctctcggatctgtaccttgatgttttttagccttgtgtctcattttgaagtgtattccaccatctaccttctatgacatattctgtaatttatttatcaatggtcttatttctctacaaaacatttactcacatgtttatttgcatttagaaataaacttagatattttctgatttaataatggcaagaattgatgttttcatacatgagcaaggtaggaggaaaaaactacccagctcttacaccacatcaaaaaattcattttaataaaatattttattaaattttaatatcaaaatttgaaatgttttgatgaattgtgaattgtaataagaaatgtgaattattgcaatagttgcaaatgtagaagaaaacctcatgaccataatttttttagaatataaatacatttatataatataaacttatagacatgtgtgttcctattgcagagaagtattacaggtaatcaataaaaggtttttcaagtataaaaatactttacatcatgaaaaatttggggggaagatgaaaatattaatgagaaaaaggaatgatataaaatctcatgctattgaaaaaagagctctcatacacacactttccactttttttaaaaatacaaatttcaggtagcaaatcctggtggtacttagaattctgtggatgcatttaaagagcactctaacagtcttatttttaaatgttaatacaacattctgaaaattataccatttgtaactatgttaagtcatgaggaagaatttaggaagttcacttaaaaatgtgcaatgaggtacatagtacatatatttcaaaattctattgggagtatgagaacaaaaagtttgaaaacaaatgttctaaccagtttccatatcaatgtggatataaaaatatcctgctaaggcctcaagatggacataatgacacagagagaaaatgggtccaaatagagtatagtatctattaaaattaaaaatacacctttcctcttatctggcaatcccacttttaggatctatcccacagaagtaaaggcagtgccatttaaagatatagttgtgatgatatttgccacacaaggtaaaacaccaagaaaatcctgagtatcaattaatagggcaatggcttaaaaatactggaacgttaatactacagacattatacaaccatttaaaataatgagttaataaggctttgagggatggtcatgagggtgtccatgatacactaaagaatgaaaaatgcaagttgcagagtaaaatgcataatataatccacttttaaaaatacaaagattactaactccccaaatatgtatatataaataaatacttatgagcacaaaaaaaggtaaagcattcctacatgccaaagtgttaatgctggttatctcaagaaattggggcagggaaaagcttttccttacacatttccacattttcttaccatttgaataagaagataacatagttgagtgtttttcaatactgaaattcgtggatttggaaatacacagaaattcaagtatttgttaaatatttaaaaagtaaacatctacaaatgtgacacagatttcttttttctttccttttttggagacggagtctcgctcggtcgcccaggctggagtgcagtggcgcgatctcggctcctgcaagctccgcctcccaggttcatgccattctcctgcctcagcctccagagtagctgggactacaggcgcctgccaacacgcccggctaatttttttgtatttttagtagagacggggtttcactgtgttagctaggatggtctcaagctcctgacctcgtgatccacccgcctcggcctcccaaagtgctgggattacaggcgtgagccaccgcgcccagcccatgtgacacagatttctatgcaaaaaataagagcaaaaaatggagaaaggaataaacaaggtaaaaaaggacacagaatttatttcagtgtgcgtaaacaaataatttcttctgaattgcattatgtaatattaaaacttaccgtacaacagtactgaagggctattgcatttaatgtatctccttcttgtatatcttttgttaatactataatgtcgtcaagtctatctcttgatgtacttcttcggactttctcttttcctctggatcgaagttcatacacttcagcatcctcctccaaaatatcactgtctgaacaatttccaaatgcatgtacttgaccacttgactgaactcctggaagaggaaaactacgattctgatgcctccctgccataatgttaaaatctggaggaaaaaaaaagcagagaaaattttggaatgtagctgatccaactgactgatttgcatgcatcgtacattcaggacacaatcttttgtttttgttttaatggttttagttatttaaacatttaggtttaagttcgtttttttgttttgttttgttttgttttgagatggagtctcactctgtcacccaggctggagtgcagtagtgcgatctcagctcactgcaacctttgcctcccaggtttaagtgattctcctgtttcagtctcccgagtagctgggattacaggcgcccaccactacgcccagctaatttttgtatttttagtagagacagggtttcaccatgttggccaggctggtctcgaactcttgacctcaggtgatctgcccacttcagcctcccaaagtgctacgattacaggtgtgagccactgcgcctggcctaggttcaggttttacaactgttaaagtagaacaaacgtatttggcagtggagacaaaggtaagggaagaagaggtaatctcctctattagatcatatatcactaaacacgtggagtaattacatattaacaaaggcaaattgctataattcttttggtaaaaatataacttataaaattaaatactataaaatattacattaaatataaaatcgtaaattccccttattctgagtatgtgaagaaaatcagagaaataattgtgttatgtcttaaaaacttgtgactatataacttatagctctgatggaatcaaagcatgttttatatacacataatactttcatgaattcaaaactttccagcttgttctgcatttcaacttcattcaggattggagtatctttcgtattacttcctcctggactttggtatttatatttagtgcagatatgcctgcaatataggttatgattttgcttccctggaagcaggaatttttcttccctggaagctttttagccaacttagagtcctcatcaaattcaacttatggtccataaagactgtgaacagattttaggttactgtgttcatttatactttagaaaaaccattgtaagactgactgggagctgacctaagttaaaaacaggcatcaatgaatactttttgtttacttgcatactaactctcaactcaccatcatcaagttgatctatctactctctttaattaggaacacaagaacctaaaaaactaattccacattcacagttttggcttcgtgttaattattcacataagaaggggcagactgctttcagttcttgttgggaaagatggagggaagtagtaagaagcactttggagataaaattctttgcactcaaggtggttcagacatgaagagagggagtaaattaagcatcacaccaagatttctgatttgcataatacattgtggtgccattctctgagatatggaagaggagctgggggaggaggtgcatggctatgattatgaattcctctaagatagtaaaaaggaatggcaaatagacaaatgggctatatagtcaaactcagagaaaaggtctaggttagaaataaaatttcatgactaatttgcacatagatgaaaatgaatttgtgagtacatatattacctagagagtatagaaaaagaagagggtccaagactgagccttgaagaagtccaaaattcagtatcttggtgaaaggaaatcagcctgaaaatatggataaggagtgtccagaagagggagaaaccatggaagtgttatgtcatggaagccaaagcaaaataacatctcaaagactcactattttttgaatactatggatgagtaccaagcgaaacaaaaacaaacaaacaaaaaacagaaaagaccaactccaaaactctgagtatataaaatggatgacaataaattacaaaggttgagaatccctaacccaaaaatccaatcttaaatactctgaaatttgaaatactttgagtgctgacatgaagccacaaatggaaaattccacaactgacgtttcagatttcagattaggaatgctaaacctgtacaggtattctggtgatgtgcttaggtaccctgaacacattattttttcactgtattaatggtatttttttttttttttttactgttaagcacttatgtgtgaaaaagtgtaagaaaatgactgcttattagtagcatacaaattcagagttaggaatgacggtgatgccaaacaaccacaaattttccacaagggtggctgagatagtgacacttttacctgctgatggttccaggtacaagaacttttgtgcacaaatcatataaaattaccttccgactatgtgtataagttgaatatgaaacacaaatttcatgttcagacaggtcccatccccaatgtatcttattatgtatatgcaaacattccaaaatccaaagaaatctgaaacacttccggtctcaagcatttcaggtaaggactacccaacctgtactttctaggcatatacttatcataaaatgctttaaaactatttaatatagttgaatccaacccttgaaaagcactttctgaccttgctctaatggcaatattataatgctttaaaagctcaagagttcctattcagataacacagataactaatagctatatgttaagtagattatttcaactgttctctgaagtgctacattattaccaagaactaggattcctaacttgacagctatgaaactaaagaaaactatcacattttatatctcaaaagcagttttgaagtcatgaccacatcttttcctccaaggataacagttttatttccactcatttaaccaggtctttttttaatcttgtgtctttaacctagggaatgtctttgaatcctgtagattccaggcaaattttatacatatgtatatttttctggggagaattttcattgcttcatattctcaaaaggcatccatgatcaaaaaagttaagacttaatatacagcaatttacacttggctataccgacctacttatgtgtcttgttagacagtttcaccctaataatttgtacttagaacttcaaaattggcttagtagtgcagctaactgaaaatcactaagcaatgccccaaagccattttagatacttgtttctatcaacctctctccacgatatatttctaaatataatttaaaggtcagaacttcacctgtctcactatctctccactcccctttataatgaaatgcaggcagctgactatcgtgttacaaatctgggtattctgaatgatcaagaactggctgtgtcttcaaccgaagtgaacagactgacccaggcgatcactccagtctactactcagagattagaaaatacataatatttaagtcatctggctcaattctattcacctctcttaattctcttagagcaggaaaaaggcacgaactccctttcagaaacttggaacaagcctgcgtgctacctagattacgaggggccacaaaacagtgttaaagcattcttcagctcagtctgtaactgaaaacggtttcccaaacaccttcgtactgtagaatggctgctgggtgtttcgccttgaccttctttaactaagcaaggtgcaataagagggtcacagggcacaagttaaagctgcaaagggacagaatcaaaggcaccctatccgctgccagggacaattttgttttttaaaacttaactacctcctccctctgtattccacacgtcaagtttttctttccctgctatcgtcagcgaagattacgtctcagagtcttctgtcacagcatgacacttgaacgatgtgacaagatgccgtcagcgaatatttcacgccaacataaagtcgtgggagaaatgctgtgtttgggtgggaaattagctgcccaggtaatccagcaggtaggcgtccttcctctgagcctcagtttccccgacagtgtgacaagagggcctggcagggctggtctggaagttcttccctgtctcgggggtgtccgccacacgggccgagcccggccctgcagcccccaccacacctgtggccgaggctcagcgcctcccgtgaggacgcagctggggctcaaccccgccctcctggaccgggctaccctcacctcctgccaccatctttacctgtccccgttagcagggagcactctgcgagaagatggccaaaaggtccgccgccgccgctgtcccgggtaagttcatggccgagcctctgctttgggctgaccccgtccgcctccgcctctgccgccaacgtctccgccttccgggccgtacgccgccgccacgtccgcaaacctgagatgcgtcatcgcgtcaagtgggcggaggtgggaaggggcgggggaggacgcggagggcagcccaaaacgggggagtccaaccacaggtccacgcccggcacgcaggcgcagggactcctccggggcccgggggcgggtccaatccccgggcccgggggcgggtccaatccccagccccgcccttgactccgctccttccgtgccgcttcactccccgaggaaaagatttggtggccaagtcagcggatccaacccgcgaccaccagcgacctactggctgcgtctttgtccagcgtccacactgcgctggcagagactgtcgggtgcaccctgaggacgaggcgtggctcaggatgtgtcggggagctgtcttgcatttttttcttgctgtgcatctcgaattttctttagggtgggaaaggacacctcaaaaacactgttgacatcacggtttcagaaaattgcgccatgtttgttacccttttcatgctgaagactccagactgctgcagaagaggcagaattctggagagaaatccttgggggaccgaggacgagggttggagggggttgtctcacccttcctgtttttaggtgagggaagtgagccacctagagtcaggccccaggaaatgttttccctggctcgaggagtcaagggagtcaacaaattgtaatctaacttattttggtttgaaaattaactgagtcattggtagtcaccattggactctatggaatattagcttattaaataaactcatgacttcatacatgatttttatcacaaatgtgttaaatgagtatcataatgtgtttgaatttatgtatgactttggcaaaagccgcaactacttttgcaccaacctaattaatgaatgtaaagcattttaatgagtctgatgtctctcagtgttgatattagagacgttgcactttgacaaccatgctaactgttacgacaatatccattttaggcacaaatagctggggtgcagggtgcagagcagtgcttttcagaatgtctgaatatttatacattagaaagcctttgaagcttggttttaaattgtttttcaaagagtatgtttttggttttctggtaagtgcctctgcaaaggttaggagttttgcattgcaatagttttcttttattagcagggataggcactgtgcttcccagcgccacaaaaaaaaactgcaggagaagacttttttaaaaagtttgtctgaattgttctgtgtgttgttgccctcatgacacccctgtctgtaaccatttatcactgagacgttctctcatcagcagacaaaggatatattccctgcttgatatgtaggacttcggctgcttagccctcatgaatgttaatgggaatacaaccttctttctgtctataggttacttttcttattttaatgtcaatagacagcggaattaatgtgagagccaaagtgatagatttcaagcacttctataggaccgatacctgtatccttcatataaataactttctcaaagatatctgcatgctcttgaatagttatttgtatttaacaaggatgcaaatattaaactttttataaaaatggaagaataggattatattttattattagaatatacaaaagaagcagttagcgtgaattttggccaagttccaaaaagccggccagtaggaacaagcattttgtctttgagaaaaaggatgtccccagtgctcagcagagccaaaggatttttagtgtttcaagatttcacctgacacagtttctgttaaaacgctatagatgaaagaatatgtcatttctaggaatatgtgttttagtcactaacgtttagtttttgtgagttgccctagagtagaagttgtactgaagtgagagtgtaaattgatgcaacctgttaggcaatatctatcaaaattttaaatgcaactgactgaactattacattgctaagtaattaccttagatttacttacagacacatatgtgcaagatttaacagatatgttcaggaatgtttgcacagtaatagccaaaatctgaaaatattttaaatgtttatcagtagttgactgatacttccggtacattaaaacaatataatgttatacttggtttcagaagagtgaagttaatctggcatttgctgatttattcattcatttacctaataagtttctgttgaagaaaaacagtgcttaaaaagacaaattccccttacttatggagcttgaatgactgaagcgtgtagaaagatctttaaaatgtattttagtctattttaggaagaaaaaataggaggtatgatattatttctatggaataaaatttcaaataagcatccctcatcctaccccccgtaccccaccgacacacatatacacatacacattcacacacacatatatgcagagagatgcacttaatttttctatctggaaagtcactcaaggaattttaacagtggctgaaaaggactagacatggcaggggagtaggcaggaaattttgccttttcctcttagaactttctatatagactgaatttttattactacatgcttttattatattaagaattaacacattttatttctaagtaactggacttgtttattctggagctaacctatagttaaccatccatctcttagtcattcctgagtctgtttgtactttgtattcaggcggcaaatgtctggagaaaagaaccagatcaattctcttataaatcaaaaaatgaaagggtaacaaaacattgaattctttttacacgtcttcttgattttcctctttctgatttctttcaaccctgctcttttactctctcctccttcctattattcctatttctatccttatagcagccttttctatccagcttctacttttcagaagcagaactagaaagaactgttggacaataaggaaatactttaagtaatctcagatgaagttaaaattggattatggagtgaaacttaaaaaaaaaaaaaactcccacatctctgatcttcaaataacctatgtagagagaaaattattgtgtctcttctctcgaagtgttggaaaaaaacagactggatgatttggatatgttctgctagcaggtgtaccacatgacctctctagctgcctttaatcctgtgatttttaaacataatgattattgtaatcatggctttgccataatgtggacaaaagaagagtcagatatacttcaggaatccaaagctgtttataaatgctagtaattaattcatggatcttaaacatgacttgaaaacaaccatcttcaagtcttcatccatgcagacacgatgaaaactagcctcacaaatactatccttatactctttagctaggtggttggtacatgtagaaaggaacagttacatctttatatttaagtagactataatttgaaatgctttgtttcccatgtctcttataatcactactgtcacataggcaaatcagtgcaggtgaattcccccagaacctgcatcctgcttgttttcgtgcctacttctccagagatttaagatgataagacagtatgtaattaagttcactaaaccaaaggaaaacctgaggcatgacccagtctatggaattgggtgatgatagatagtgatcacccagaagtggagagcaagtcaaaatggagtacagagagtggacgtccagtttgatttcttaggtcttcagcagtgcattcacagagacaggaaagatagggagtggggaagaataaaaggataatgggagaggcaacagcatcttctctttctagtctaggtctttccagatagagaccacttctgtgacaatcctcagcttagtcaacactatctgacaaaaccaagcaagaatttcaaaagcaaaacttccgtgctcatttaaagaataatagtgaggtgtacatgcatacctaaaatgaaggtagttgcttatctgacaaaatatagacagaaattacatctgttcattcaacaaatgttaattaagcagcaactgtgtttcaaatcctgctttaataaagcatcagggacatgcaatgaacaaacaaacccaaatctttgccctcttggagcttatgttcttgtgatgaaagataaaaacaaaataaataaatgaaattgtgttagatggtgataagtgaatggaggaacactgaatagggtaggagctgcagtgttttgggttgggggagagtctccaccctatgaaaattctctatccctgagagaggaactgtgcctagagtattggaggaacaacaaagataccagcatggctggagcagattgccgaagcagcgagcagtaggagaagaggtcagatagagccaaatgggaaaggactctgtcagccactgcaaggacttgggctttcaccctgagcaagatgggaaacgattggagggttctgagcagaggaggtcatcatctaccctttaaaaggatcccataggaaagtggaggcagcagcaaggagatcagttaagaggaaattgtagtaattcaggcaagagggaagatgtctcaaattagggaaaaacatcaagtatcacattgatgtgggttaaaaatacttgatttaagaattttttcaaagcccccgactctatgaggatgctcaattttagttttaaagatatttttcactagttccttcttgcatactttgattagtgactctgtactagggcctgttttccacattaattctaaataagccagatttaccactgtagcaattgttggatctaagtaaagtttccattctgccctctcaccatgttttcttttatttacagttaagattgagctgaattttttccccttattccaagccttaatcctatctggcttctaaatcccttcagaattatttgaagcaaagaatgcctgctgatttcaaaaaacattttacacttggacttacttgatggggtatatagcaagggtcgtggaggcttccttcctttccatgcagaaaaatgtgtttggaaatgtatatactaatcaatgagcaatctgttagtaagaaacatacagaagctcatttctttgatttgttgttttgaaaagtacttatttttctttggagtatttttcagtttaaaatctaatctgttattttgtagaataatcaatttatattagttgaaacttgattaactttccttttattaccctgtccttaagatcatactacagatttggttatatatcacataacaatataaatgaacacttgttttataaagatttctaattctattgtttcagtcatttcattgaaagataaatattactacaccaatcttctaaggaaaatttcttgtgtgttattcctggctttgtataagataatgtttataggcattgtatgtaatgctgatgcaatagaaggcattatatttaaaaagaatggctttactgtatacaaatattaggattgcttgtaaggcaaagccataaaagcattgcgtaatctattctaataaaatagatacgctagccctttgactttatttggttttagcaactgaacaggatagagtttcgaaatgaatatggtgaaaatagacaaaaggatttatagtaaattttttcctcctgctctgtgttacctcccatgagccttgttcacctttttctcaatatctgccattactcattaaaattctggtttcataaaaactacaagtagagactgctgttgcttgttgtatgtgtgtaatgacagcactcaaatgcattgctaaaggactggaaaacacaagcaaggattatgataagaatggtaacaacaaccactttcaacatgtataaagttaaggcagtctgcgcaaaactgacattttgataactatacaaggtgttgtcaaagtatgatctcagaacccctgccaatccccaagactccttagtagggtcctcaagtactttcacaataattctaagaagttatttgccttgttcactgggttatcacttgcactcaggttactcttgtacagccatgggagatgagcccacagagagccaaatgggataggactttgttagccactgcagggacttgggctttcactctgagcaagacggcaaacaactggagggttctgagcagaggaggtcatcatttaccttttaaaagaatttaataggaaggttagggcagcagcagagagatcagttaagaggcaattgcaggcagatgcggtggctcatgcctgtaatcccagcactttgggaggccgaggcgggcggatcatgaggtcaggagatctagaccatcctggctaacacggtgaaaccccgtctctactgaaacaaaagcagaaaaaaaaaaattagccaggcatggtggcaggcacctgtagtcccagctactcgggaggctgaggcaggagaatgccatgaacccgagaggccgagcttgcagtgagccaagatcgtgctactgcactccagcctgggtgacagagcaagactctgtctcaaaaaaaaaaaaaaaaaaaaaaaggcaattgcagtaactcaggcaaaagggaggttgactcaaattggagaggaacaccacataccactttaaaagtgttccttgattaagcagtaaatatatatttattgtattaaatctcagtcctggaggcaggatgcagtggctcacacctgtaatctcagcactttgggaggctgaggtgggtggatcacctgaggtcaagagttcgagaccagcctagctaacctggcaaaaccccgtcttttctaaaaatacaaaaattagctgggcgtggtgacatatgcctgtagtcccagctacttgggtggctgaggcagaagaatcgcttgaaccccggaggcggaatttgcagtgagccgagatcgtgtcactccacttcagcctgggcgacagagtgagagtctgtctcaaaataaataaataaatcaatctcagtccttgaatatatggcttttattattctttctgatgaaacgggaaatgcacatgaagttcttctgctgcatgtcaaagtaatatggttgtctaagaaaaaaaatctggtggccttgtttgagttgggaactgagcaaaccgtttttatcaaaggacactatttttaatagaaagaatgactgacagaaaaactatggttggctgggcacagtggctcatgcctgtaatttcagcactttaggaggctgaggtgagaggatcaattgagcccaggaatttgaaaccagcctgagcaacacagggagactccgatctctacaaaaataaaaaattaaaaaaattagctggtcatggtggcgcatgcctgtggtcccagctactcagtaggctgaggcaggagaattgcttgaagctgggaagttgttgctgcagtgggctgtgatcatgccactggatcccggcctgggtgccagaccctgtctcaaaaacaatgacaaaccaaatatgatcaataagacttggatatttgatggacagtttattgaaaatgagcaaagtaagccagttacttccagaaaaaaaaaaaaagacagtagttgctaccattgataaaactcaagttctcaagcagaaattagaattttagaaaacgtttattgcctctatgagggttggcagcttcccaaaactgaaaggattttgtgatgagattagcggtgatatcaataatgtaatttttcaaatatcgtatatattgaaatttgtcaagacttggaacatctccataactcagggaacaatattttccaaataagtaaagtaagatgctaaaaaatcatgcacagataaaagatccatttaaagtgtaaggccaaggattttaatgtgactgatttgaagaaaaaaaaacttattgctatagttttattaaccaaaaattgacagaggcaaatctaattggatagaggtttattttgccaaaattgaggatgtgcctaggaaaaagaaacacaagttacagtaagatctgttacttgtgctttttccaaagaaggttttggaaacatcaatatttaaagtgaaaataacaagcagaagggaaagcaaaaaaaggaggatggataggcaatgagggaagtggttacattgttgtaaccactctgaatagcactcagtgaatccatgttttacatgcaaaaagaaggaggtaggcgaaaagtcaatttgtattcctcttgtgttccataagtttacattttacacaagataaagtaagcatgtgaaatggcagctctctgtttggacaaaaaaggaaggcaagttttgtgtcactcagttctcaagcttaactttgccttgggcatagtgagtttggggtcctgaaattcattttttccttcagagcttcaaatgctacattgcaacttacctttaagaagctatcactgagtcttggtataatatcaaagaagaatattcacaattgtctgaaaaactattaaagtacttttccctattccaactatgtatctgcatgaggccagatttttttcatctacttcagccaaaaccacatataacaacagactgaattcggagcaaatacaagaatttactggtcattacagctaataaatgacttcagtaaacttgaaagatgcaagatacacacacacaacatcactagtatttctgtacactaacaatgaacaatctgaaaaagaaactaagattgtaatagcatcaaaaaatacttaagaatatactcttatcaagagatgtaagatttgtacactgaaaactacaaaataatgctgtgggaaaataaagaatatctaaagaaatggaaagacatgatgtgttgatggattggaagaattaatatcattaagatgacaatacttcctacaaatatctacaaattcaatgtaattcctatcaaaatcctactggccatttttttagaattgaaaaactgatcctaaaactcatataaaatggcaaagatcctgaatagtcaaaatactcttgaaaaagaagtacaaatttggaggatacacacttttgaatttcaaaacctattacaaaactacaataatcaacagtgtggttctggcataaggatgttccatggtggcaggtctatgcaagactacccttaaaagtctgaggaagctgaaaggccaaagaaagaaaataaggtatccagtttttcagaaataaacatgattaaggatttatgaagacaatcatgtctgtgtctcggtggtggtgagacaagatggtggatatcagcaccttcactcctcagggataatataccatagggaaggaatgtataggacaactatagagaaaggcaagaatgccatagtaatctcctgaagcacaggatttatggtcaaggttgttttgacctaaggacaggatttgtagtaagtacatgctcttacacaggagcagtagataagatgaaaatattagaggcattcctggaactggggtcaatcagaagtcaacagggcagattagcatccaagattaagttgctttagcctttacagatatacatatagattaatattgtagaattgaaagttcagaaataaaaacatgcatctatggtcaattgatatttgacaaagatgccaagaccattctatagagaaagaataatctcttcaacaaatgatgataggacgcctggatatccacacacaaaagaaccatgttggacccctacctcataacatatacaaaaattaactcaacctggaaaaagacctaaaaattagagctaaacctataaaacttttagaggaagacatagacataaacagtcataatcttggatttggcaatagctttttaagtatgacacaaaagaataaaaaacaaaaagaaaaatagatgaattggactccatcaatactaaaaacttttgggcatcaaaaacactaccaagagaatgaaaagacaccctatgaaatgggaggaaatatttgtaaatatgtatgttgtctcgtattcagaaatataaagaactcttgcaactcaacaacaaaaagacaaatgactcaattaaaaaaatgggccaggctaggtgcggtggcttacacctgtaatcccagcatttgggaggccaaggagggccgatcatgaggtcaggagatcaagatcatcctggctaacacggtggaaccccgtctctactgaaaatacaaaaaattagccaggcctggtggcacatgcctgtagtcccagctactcaggaggctgaggcagaagaattgcttgaacccaggaggtggaggttgcagtgagccaagaccgcactactgcaatccagcccgggcgacagagcaagacttggtctcaaaaaaaaaaaaaaaaaagaaagaaagaaaaaagaaaaatgggcctagaattgaacaggtatttttacaaagaagatatacaaatgaccaaaaagcatttgaaaagatgcttatcgtttagtcattaggaaaatgcaaatcaaaaccacaatgagaagccactttgtattcactaggctggccacaatttttttaaatggaaaatgaatatttgtaaggatgtcgagattggaactctcatacattatcggtgggaatataaaatggtgcagttgctgtggaaaacagtttggcaattcttcaaaagtgaaaaataaaattaccacgtaactcagcaattctactcttaggtatatgctcaagagaattgaaaacaggtgttcaaacaaaaacttgtacataaagttaattacagcactgttcgtaatagccaaaaggtagaaacaaatcaaatgtccatcaacagatgaatgggtaacaaaatgtggtaaacacatacaatttgagtattattcagccgtaaaagggaatgaagtactgctatatggtacaatatggatgaaccttgaaaatattatgctaagtgaaagaagtgagacataaaaggtcacacacattgcatgattccatttatactgtaaaatctagaataggcagatccatagagacagaaagcagattagttgttgccagggaataaggagggaggaataggaagtgactgcttaatggttacaggttttcccactgagaagctacaaatgttctggacctagatagtgatcctagttgcacaatattgtgaatgtactaaatgccaccaaattgtacacgttaaaatgataaattttatgttatgtgtattttaccacaaatttttaaaaaagaatccagctatcttctaagtcagacattaaagagatttttaaatgataaataatgccactgatctcactaaatatttttgttttcaaaaatatatttttcataaaatatgttatttcaattaacatgaaatcagtttatttttaattgaattaatgaatagatacatagaagttgtgactaaaaagtttgagacccactaagttgttgtgtaaggtgtagcctcaaaggtatctaagccaagttactgcatgggttttaaggttcaaaagattttctaatataagtcaattgtgaatcaaaatgttacagattaaagcacaactagaaaagatattcttctgatcatattagctaccaaagtgtaaactagaaggttagaaactatatttgttggaggcatggtctgaagaaaagagtggggaagctgaggaagggcaaagttggagatggaaagcagcagagtgggttccatctctacagctggaatgaaggtggccaggatgatatggtttggctttgtgtccccacccaaatctcatcttgaattgtcatctccaggtaatgaggaagggacctggtgtgaggtgattggatcatgggggcagttttccccatcttttctcatgatagtgagtgagttctcacaagagctgatggttttataaggggctcttccccctttgctctgtcttcttctctcatctgctgccatgtaaaatgtgcctgcttccccttccaccatgattgtaagttttctgaggcctctccagccatgtgaactgtgagtcaagtaagctttttttctttataaattactcagtctccaatatatctttatagcagtgtgaaagtatactaatagacagggacagaatagttacagggacccgtcaggatgaaggaaaaaaagttataggagcgcaggctgtgtcagccactgaagtcatggaattggggtggatgctgggaatggcgagtggtgggtaaagagggtgttggcctagaaaattcatgattcattgcgttaattcaatttgacattcatgtaataggtttaaatgtattttttctctgttttctagctgtctgtgctaataacacagagcttacacttactgattattgtgtcaggtattgttctaagatttatgatgtggatggcactattctttttatttttaatacaatttttgaggaagtatttgagaataagctgcagatatcatgacacttcacccttaaatactacagcatatgtctcctaagaacaaggacattcttctacataatcacaacacaattgtaactgaaaaaacataaaattgatacagtattattctctaatattcagttcatatttaaatatccaagattaccctgattgtgtcctttatctggttttccttttttctttttgagacagagtctcactgtgtcacccaggctggagtgcagtggcaccatctccgctcactgcaagctctgcatccagggttcacgccattctcctgcctcagcctcctgagtagctgggaccacaggcgcccgccagcacgcctggctaattttttgtatttttagtagagacggggtttcaccatgttagccaggatggtctcaatctcctgacctcgtgatctgcctgtctcggcctcccaaagtgctaggattacaggtgtgagccaccgcgcctggccctttatctggttttctttttgtgtttatttgttttgtaaaccagaggtatctgatacaaatctcaatcaatttagaagtttattttgccaaggttaaggacatgcccatgacacagcctcaggaggtcctgagaacacgtgcccagaattattgggttacagtttgattttatacattttagagggacagaagttacaagcagacatcaatcaatacatgtaaggtgtacacattgttttggtctggaaaggtgggacaacttgaagtggggcaggggcttccaggtcataggtggattcaaagattttctgattggcaagtcgttgagttattgtctaaagacctagaatcaataaaaagaaatatctgggatacaataaggggatatggagatcaaggtttttgttattcagatgaagcctccaggtagcaggcttaagagagaatagacggtaaatgttttttaccagaccttcaaagatgccagactcagtaaatctctcttacatcaggaaagtactggaaagggaatgggattctctacagaatgtaaatttaccccacaagagacagcttttcaaggccatttaaaagtatgtcaaagaaatatatttgggagtaaaatacttctgatttctttcagggcctgggatctgtcattttgcaatgtatcttattgccgcaaagagtcagtttggtcagtctgaagatctctgttttaatgttaatgctggtcagaagtgtctgaattcccaagggaggagggtataatgaggcatgtccaaccctcccttcccataatgacctgaactagttttttaggtttactttggaatgcccttcaccaagggaaggggtggtccattccatcggttgagggggcttagatttttatttttggcttatagttaattttaaaatgcagtccatgatttaatcaaggattatgcattgcatttagttgtcaagctcctttagtttcttttaatccagaagtgttttccagcttctctttccccatctcaattttttggtctgacatgatgatggtatttttaaaaaatataggctgtagttgtttcgtagactacacttcaatttagatttgattcattgtttcctcatgattagattgagattaaatggtttttggcaagaaccctacattggtgatgttggatacttctctgtgcatcatatcagaaggcacataatgtcagttttcctcatgattggacaccgagcactgttctatgtactttatgcatttaatttttaaaacaaatttatactgtagctattgcttttatttattatagatttcagtactttatacaaaaggacactgagaaattaagtatcttgtctgaggtcccagaacagtgtcctgaactcagacagttgttccagattctgcaagattagctaataattacattgtgaagaaagagacaactgactctgtgattcttagctcatcacctacctccagggtatataagtggaggccagaatattgatctttaagcctttagtaagaatcctcttagagttgtcattgtgctgtgcaatctacctctgccacccctaggtaaaaatggcagacaatcagaggatcacttggagaatttgatgtggagtttgagggacagagtgactgttacttgactcatcttgagaaagtccaacagtgagtttgaccctgccctggaggcagaataattgtaggagataggtgtggtgttctgagggccagctgtggataggacaaatgtgtctaaatttcttaaggcacctcattcacaagacccatcagaagggatgaatgaacccctgtggaaagcatctgtgatggactgccagaagttagagactggggggttaattgtaaatgggttgcccaggaagacctagcccatgttggggtccccacagatgacagcgccaaagaactcattaagaaataacatttttttacatcccttatgcctttccctgctttccaatcctggaagagccataaaagaacatagcaaaaggggataagtagtacagttgggaggaattgaaaaaaaggataagcatgccctctttttccactgtaggctttataacctaggtcaggcaacgatctaactctcaaagcttaatgagaggttaagctttgctttgtgctatctgagaaataaggctacttgttaattgaaaatgaatgtgacaaatgggatctactcaaggtttcatcttggaacagaaaggaacgaataacaatgcaaggtgagaaagtggtcagaaggaacagaatttagttaatacgataaattggctactgaaatattgaaccgctttctagtatttctacactgggttagttttatactgaactctgggaaagaactgttttcttggtaactgccagactgtctctgacctttgactctaatttaggaagagttattaaagttcttctcttgagaaattgtccagagttttgtgctgtgttgcttttatgtgaactgcaaatagaacacttccaattgttgagtgtagtagattatcactgggaatgtgaatttttttcagtaatgccactgaaattctgcccctatagtgggagccaactgcagttgtcctgagcatagctaaacatttgtttggatattgattctcctctagctgctaagctctggagtatggatgacgactgtctgctctccatctcccatccctagtgctatatttttaaactcacttgtacaggcagcactcagtggccaagttctttttctctttcaactcagtcccattctgctcctcttcttcaccctttcttcttctttcctttcaacactgttcctaaaataagccaacttctaatctttgaactttaccttcatttctagcactaaattttctctctaaacacctagaggtgtttctgatcagagctgggatgatcatccacagataggctttgctcttgccctctagttccattagtgtaaagcttcaatcaaccccactcccacagctcctagtcctccctctaagatcttccaatcccctcaataagccaaaaatgcctacttctgggcccctcaaggtaccaaagggagaaaggctgtcactttgcttacgtcagcattttgtagaagggtataaaagcagagctgatccacttcttcaaatggggaagagcatcctccttttaccatcatcacaaatagataaacgtttctcttaaagtgccccatgacagctgagaatagactcagactgagtaatgagatatttttgtatatgcaactttaaaaaaattcttaaaggtagaaaaaagaaacattaattgattcatgtgtttatggaattccatatgaggtggctaaaaaagctaaataacttaaataaataaaataaaattaagtcaatgtattttgttccattgagtgatgatgacaaagaacaaaataggctgccgttttaaaataggaagaaaattatatattaggttgaaccatatgaaattgctcttattcaacaattctggtaatattgaacattttaacataagaaaatatcaattgcatgtggttcagcctaatactgatgttttaaagacatttctgatagtatttctctgctgtaaatacttttctacttaaatgataatatatgttagtcaatttttcttttgtattatttttaattacttcataatgccagtagagtgcgttggctgtgtggtgatatcaattaaaatttaagaataaaaaaaaaggcatatacacatctggttatgatttgcctttcttgctctccagttgcataattcaacttgatgcgcataattctctttccttttattcaattccatgtggtggcagaactactaccaaaagatgaatactttcagtacctttcatatgaaagctgccgctttcacattctgtcctattgatactgcattttggcagtggataaagggacacagttaaagtctctgctcataattggttttatctgggaaagattttctttgaactagtggccacccatgcttttataattatcagaaattaactagctcagcatttcttgtaagaaatattcacaattcacttccttgcttttggaagaaaagaaaagaaagacagaaaaggaaagaactaaggagtattagagaactccgttttgtttgggaatattccatgtgagattgctctaatgcaatgctaaaactgtgtgtttcttcatggtactctttgaaacacaatctcaaccttttttcagaaccctacaaaaaaaaaaaaaagaaaacttgaaaagaatttttgttttctgaaaagtgagacaatttcagtgtaagttttctgatatgacctgacatttacaagtcacaaagtattaaatctttgtagaatatgtatatgcatttcaatatgatttgaaaggtagagcactcctaacttcaagtctaaaactgttggcagagatgtttgtgtcaagtggaccaggcatccacacataagatgtaaactttgcaagaccttgcacaatctccagacacaccataagtcaaccctcttttctcactgggcttggttttcccacccatgagggaatagacagtgggagctttgtttgtagtgtctttgtttgcttgcagccactggtaaaacaaacattacttcagactgaagaagtccttggttgagcttgggggctctgggagaacttttcctatatcccaacacagatgacttcatcaggttatctggtgtagactcgccccacttaggataattggattgcagcatcctgtgcatatccatgtaggactggatgtttagtgagagactccccacccatgggaagggatctgaaagaggaatattgaagagaaacttgccctctttcactttagcctgactctatctgtcaatgaagcttcaaaggcacttcagggtcttgtcaggcagcattatagtcttaaaaatttctcataatttcatctttggacagtactgatgagctctgcactggacataagccactgagggctgaaaatgtacacagtgaatccttgaattgagaaaacagtctcattttgtgacccaatctactagaaacttacgtgattataaaaacgtatttgaagaattctcagtattttgcaatagaaagggtcagttttataattttaaatttgttgaatggtgaaggcattaatgcatggaagtgattattaataaatagaaaggtttggtagataacatgcttcttgttacttctgtttcaagatacgttatatatagaagtggaatttaatatgttttatatcatagatttaaagattttgtaccaaaagatttataccgtcccctcatctccatccccccctcacatacctcccaggaaattaactgtttgaactcatcgttggataagtttaccacagcccacagaatatttctggaaaatttaaattcttttttactgtagtctctggaatgtaaatgcaagcttattataagataattatgcaaggagtggaaaccttatattctatcctcataaataaagtgtagacagaaataataatcttggctcaactggaactcgaagttaggaatgaaggatttgtttgccttgtctcctcccaaacctcaagtaataaatctcaaaagcttcaatattgattcaacaaaatgaatggctgagtcatttcagaaggactctgacaagtggacaaacgctgccatggcgacattttgatatgcagcgtgcttactgagcctggctggcttcctccccctgccattaaagcaaaatgacaaaccatgggaagtgccacacacagcgtgcctaaaccagaggcaactgggggtgaaaaacagatttaattagctgttctcaaaaagttaaaaactggatatacatttatgtttgatttatggaggaattccttttaaaatgtgagaaaaactgctctgagatgtgcttcttgctaagaaatagaaactattattgattttaaagtctcagacagcattctctgtaaatgttttgtaaacatactttgtaggataaaatatttttagcttggaaatacagatttaaaatatttcccataggacataaattctactcaattcgtcttttactgaataatgtaataaagtattacatgtggccagtaaaaaaaaaatacaatatgtgtaatcacatactattactgctgcatatatttagatttgtaaggaaataaatgtcggaaagtaatatgtatacttggatattacttgatcttaatattcatttgatggagctacttaggaattacatatgtgttcttttctttattagtataaagtatatcaagatatattaaaagcaggagcaattcacatcaatgaaaagatgttattttaaaacttttagtgggaaattgctattatatatgcgattatgtatttgttaactttatttatgtataattaacactgtagttttttcaatattgaattggttaactgagaagaaaaactgtctcaattgcagctaaaatacaactagagtaggcaataactgttttgttttattttgctgtttttctgtttgtcagttattaaaatctcactatgtagcagacttcactatctcattcaatccacacacaagcctgagcaatgagtcctaggagactctctattttgcagataaggaaactaaaatgtgaaaggttaataaattaatctaagttcactccacctatctacactatatgatctcttgacatcatctggacctaaccatattaaatgtttttatttttgctattctatggctttagaaatagaaaccatactagtgactgatatcacaaagtctcagacatcatgttctataaatagacttcttgaaaaaaacatttttaacttaggaaggtaaagatttaaaatatttgcagtagaacatgaagataatacttaatttatcatttgtattttacttattaattttagaacatttcatgagagtataaaaatttagatagcattaggagatatacctaatgttaaatgaagagttaatgggtgcagtgcaccaacatggcacatgtatacatatgtaacaaacctgcacattgtgcacatgtaccctaaaacttaaagtataaaaataaaaaaaaatttagaaaagagaaagataaacaagtacaaaaaaagtgaagtattaatttcacatgaagaagcaaagagaaaagccttttttgttgggtttgtttgttatcacgcttgtggtttcagcttctaaaatggcacctcaacttctgttgtctgtgaggatctgggttgactgctggcttatcaaacatctcagtcttaaagaggaactactttttgtatacttcatctatatagggaagaaatcatttacagagaagattttgtcacatcacattaaagatttcaaaatagtcataataaattatgataaatttgtcaccactagataacccacacatagtctagataagatccaaaggccttggcaagacaggaaaatgtggagaccagactcctagacgcacttcagattcttccctctgggtcactccatgaagctttttgagaagcagctttcagtgggcctaccttgtccaaatagaaccaaccaaggcttgagatgctgctcacaccttaactcctttctgggaaagtgtggtgtcatgtctccctggagctatttttgagctcttgaaatctttctgctcttctgctttataccttccagaaggacttactcctctcaattttccaaaatcttccccagcttttcttttctttctttcttttttttttagtggtggtcagggagtggggaggagatgggatctcgctctgttgcccaggctggagggcagtggtgctgtcatgactcacttcaacctttgcctcctgagctcaagtgatcctcctatctcagccacccaagcagttggcactataggccagcgccaccacactctgctaattttttttttttttgagatggagtctcgctctgtcgcccaggctggagtgcagtggcaccatctcggctcactgtaagctccgcctcccgggttcacaccattctcctgcctgagcctgccgagtagctgggactacaggcactcgccaccacgcccagctaattttttgtgtttttagtagagacggggtttcactgtgttagccaggatggtctcgatctcctgacttcgtgatccgcctgcctcagcctcccaaagtgctgggattacaggtgtgagccgccgcgctgggctgctaatttaattttttttttagagataaagtctcactgtattgcccaggctggtctcaaactacggggctcaagtgatccacctgcctcagctttgcagagtgttgggattacaggcattggagccaccatgcctggactttcaccagcttttcaatctcctcataaagtacatgttttcttatgcagtcctcattggagagacagctccaggagcaccagtcacatagatttcatgtaaatggtaattacgtgaacaagagttgcacaactcctgcacccatgaagggactgacatggacaggcatggccctaagccataaggatgtcaaaccccaaggaaactcagtccccttccgttagctgccacactggaattcatatgactttgatgttagacccacagtaaggctttaatacttctttaaaacagcacttccaaattgtattttgaatgttaattggaataagactgaaaaaaatgtttctatcttgctattttataaataaatttgtgaaacagcaagttaaacaaatttaaactgattttatgacagtactcatattttaatattttattaaattattattttaatgattttctaagaatgtttcccacatttgtggtttgaggcttttgccctttgcaaaattggggaactgaaatttatagtaacttttttttttttgaagtggagtgtcgctctgttgcccaggatggagtgcagtggcaaaatctcaactcactgcaacttctgcctccaaggttccagcaatcctcctgcctcagcctcccgaatagctgggactacagggacatgctaccacgcccgcctaatttttgtctttttaatagagacaacgttttgccatgttggccaaactgttcttgaactcttgacttcaggtgatctgcctgcctcggcctcccaaagagctgggattacaggtgtgagccacggcgtccctctccatagcaacatttttagaaatagtgagacaactggtttactgaggaattttaattcagtggggttcaacatgaatcagcattgtgatctcccatatcttctgtaggtgtcctacattctttctcactgggtagcagatcccttgggcagatttcacaactgcaatataatttaaagcaccaatctcaaaccatatttaaagctttctcctccaagagaccaatttgaagagagagagagacagagagtgagagagagagagagactgtgtatggtgattctggttttaggaagccccttttctacctgttccttttcaaagcctaactcttctggatactgagggaaaataggaaaaggacaaacatccttttatttaacatgcttataggaacagtgcctttctttagggttgtggttgcttctcttgataacagactagctcctgcctgtgtgaccagcatactaactttcccaaaagcacacaggtaagttcggttggcttctgcgagcctaacccatagtatggttgcttgaagtatgttcttccttaactacctccttcagctattgcccagaagtacacagtctcttattcctgggatcttcctgctgcataggctgttctcttgtcaggtattggcaatattttgcttatgagcagcttacatagtatcacaattcatgggagatctatacatctttgcacaaaggtatgagtgaggcttctcccttgcagtccttctctgggtcctaccatctttctttcttaaattctctttcctcttagtggtaggcttagggcagatcaataaggtattgacatccaatgagagaatgagttgctgtttctcactctctaatacagtctccaatctctaccacaaattttctggacaagagagaaaagccagaacctccccactaggctaactacttatgactgcctctttcctttttcccttcttcttggggtgactatggaggcaggtaattgtcctatattcaatcctttcacctctaagaaagctctggaagtagattctgttccgaatggttggcagatttctttagaagtcatgtacttgtttctttggtcccaacctgtacctaatcaccagttccaggggagcagaagatgcctcatttaatgcattggtttataatatcatacaatgttcatagcagttggacacgaagtaccagtgggtgcagatgctcattatacttgtttgaatttttttagaggttgagaatggggaatttggcataagtctggtaagagtcagaattttagatcagattaagcaagaagttaaccagaatctggatgtatagcaggtttgagagtctgagagtcaggtgaaaatattgatcagaaactaggcagagaaagaagaaacagaatattacaaaaatgaagacctagaacagaacagtgcagatttttttttttgcaaagaatcagagatagaatatatttaacatgtaacacgcagaggaaccttgtgggacaagccagcaaattctgctacagaaagcttcagccagcaaattctgctacagaaagcttcttgtgggctgggaccatgtccttattcacctttccatctctgaggcattatgcaatattggcacttagtagatgtttgttgaatgagttagtcaatttaggacagataccagtatcaaaaaaggacttgataattaagtaatttttgcttctgcatagagtaggcattggtacactatgaccctttctgactgccactttttgtagatattttattagcacacagccaggctcatatgtttacctattgtttttggatccattcacactacaatgaatgacaaggctgaatagttgccacagagactatgtggcctatgaaactgaactgaaatacttattatctggctctttatattaaaggtttcctgatgtctaggcatacaggtttaaaactgtttttacatgtttcctgctgactcagttatagcatggctaacccaggtcctacaggtagaggtgattgggaacacctggctgttctgtcagaagtataacagtaagtcccagagctgaaacaggatgggtgtgagagttctctctgagccaagagggaagtcatcttgattcaaacaagtaatctcttccctcctttctttgaatcatctttccttatatatctctgatagaactgttcacactgtacttagaatttatgtcttctttctcctattgaagtggactagatgaaggcagagatcatattttgctcatgttcatattctgagtgtctaatgatgcttctgaataaataggtactcatttaaaatatgcattgcagctagctggattatgatactattggaagaagaggaaaagcaaggtctggcagcttagaggcagcaggttattaagtattattaagcaagagatcaattaaatgaaaatcagtttggagcagagtgtctgagtgagtggcagtaccaacacatagctctgtgtgaaagactgtttaggaacttcctcagacttttggaggctttttatttccaaaagcccaagaatattcatctttttctgacactggagcagattctcaggctgaaagtagtctttgttgttaaacggattctctgatccctttgggacaggaaattctttcctttgacttacaaattctgaatcaggttctgacaatggggcctccttctcacttattttcccaatcatatcgctcatttaaagaatgttaagagcctatttatgtgcctgactctgagataacttggatttaagttctgtttgttttttcattattgctacagtttggacatttgacccctccaaacctcatgttgaagtccaatccccagtgttggagttggggcctaatgggaggtatttggatccaccaggaggtggatccttcatgaatagcttggtgctgtccatgagtgaattcttgctctattagttgccgagacaactggttgttaaaaagaacctggtacttcccagctctctctctggcttcctctcttgacatatgagttctgcacctgccagctctgctttaccttccaccatgagtggaagcacctgaagccctcaccagacgcagattctggtaccatggttcttgtacaacctgcagaactgtgagccaaataaacctcttttctttattaattatccagcctcaggtattcctttaaagcaatgcaaaaatggatgaagacaattatagagttctaaaatgataaactaaaatctatggagaatgttactacatattagtgtgcaaatgcagtggggttgggggactgttgatgtgactgggtgccttattttatctttagattctaggtgggtctgaacttaagagtggggagagaaagaggagttcaagtccgtggctcctgacaatcactactttttcttttcctatctgggacctagggcccaaacagaaaaagcctttaaaggcagattcgggtactctcgaagtattatcctacttttacttttggggggtaagagagagtagatattgcctgaacttgattttgctgctttggtgaaattcctttacgcatgcctaaacttagatatgtgaaacctaggatataaaaaaataccattttcaagggaatataaagatcttttcacaagatttataaggtttacttagtatgcaagactaattaaattggaataggaaggaaaattgtatgacatcagtacttttcttattgggtttaagaaaactaatttatctttactgtgtgaaatttggagctactgggttgattttgatgaagattactgtaggagaaaaggcttacattctaccattgttgcttttaggcagaattgggaattgggctttgtctttagaaccttaagctttcctttcaacacccttatctctcagtggcacctgacacctcccacctccaggtgcctagtaatgcttttcctttctttttttctttctttctttttaaatcaaagcctttgaagaacaaaggatctctaagatgtaatgatggatgaggtttaaagtatctctgattcaggcatatttgtattttacatgggatcaagtcttatgttttgtaaggttggattgtgaaatataaagaaatgaaaaatgggctctgggaaactttttaatatgacaggctttcaggcccttccttccttttccttcctcccttccttccatccctcccttcttacctcttccctccctcccttcctcctttccttccttccttcatgtactgagtttctactatatcccagagactattctagctactgagtatagagcagcaaatgacagagacatgcaagctacccccatgcagctttcatttttatggggagacaaaaacacctaaatatcttaataagtaaatgggatatttattagggataagttatagaaattacatagaagagggtagtggctgagagtggcggtgaaagttatcagggcaggtgcttccaaggaagagatagttgagctacccctcaaatgaggtctatgatagaaagagccagccatatgaagctctgcagaagcagtgtgcctggcagaggaaaaagcttgtgcaaagtcttggaggcaggaatgattttgctgtggttgagacaaagaaagaagcgtcagtgtgataggaatacagtgaaatggagggaaagtggtactagatgaggctggagaagaaaagagaaatagaattatgtgaggtctcttggtccatgttaagaagtttggatttaagttcaatgagcatttgtttaataatttcagcatttgagagtatctacactactttgtcaagtatttgtaccacaattaccaactatgttgtttcttgtggttttattcttcaaagcaaagctttttggagaagccttcagcaatccatacactctcttcttcctagagatttctagcacttgagtggcttgttttttgcatggcatattctgcttttcggttgattaactttcaccccagaaagagtgcaaattaataaacttagggtggttttagagatcactgtttttcccacagtgccttacagagtcttctgcttcctaaacacttagtaataattgttaattacctagttccctgaggtagattgggtgagggtgtaaattttcatttactcatcacagtgcctagggtaatgtcatacacaaagtaaatatgcaagctgaggaagtccagttgtggggaatgtgtttaatcatgggacttggtgaaacaaaaattaagatggaatatttggttggtagacgttgactttgccagggtatttagccacaaataaagcctttacaaacgctaataaaacaacactgtgggttgaatatacattttagtaagacgttttaaataatcaggaagaaaacatttttctgttattgttttctgttttacatgtgactacatggataattgattcacagttttcactttaagttgctttgaagttaccgttcatatatggcaggatttagtaagcatgtctgtctgtgtctactccgttgatatgctcgtggatttaaagcctccagacccaggtccgacctttgttgttgagcctcacaggaaagctgttcaatctcctggatcacctaggttgctattctccccaccttttgcagcgccttgatgtgtcatttgcattcccacacggtttctgtataagaatcatttagtctcaacaaacttgccgtttgatacccagctgtttgttgagtattgcagctttcagaggaggtgctcagcaacagctcataataacgctaaatgagtgcccctggacggcagtatgtaacacaaagtatctagttattcctattccaattaagaagagtacttgtgtgagctgcatttaaaatgaggaggctgagaacccattttttttttctataaaaagcggtgagttgctgtgggagtgctaatctttctctttgctcccagtttgaaacttccgtgattctaataatgctgcatttgctttaaaaatctctggtgcaggcggggatgtgcacattgctgatggtatggtctgacattgagcctttacctttgtgtactgggaaagataagcaacatttgctgagggtttaccacgtgccaggtgtactgtaaagagttgcacttcacacagtctcattcatctactcctaacagccttatgagtaattaataatcctattttataaatgaggagacagacaatttatcccagatgttgacctaaatccctgctttgtaagttcagttgagggtagatccttcctttctaatatttcatcaatttatgctcaaattcttatggggtaaacttagggagagcttcggtaaacgtgaaacgaaacattctcttaggaacgaaaaaagactcagtaaatgggttttttttccctgaaagaaaactaggaattgcttacagtggagtacccagggcagtgtgcaccactgtccatggtgagttccttgtgccgaagggggcaactagaaagtttagccaaaggagacgattagaaagcactgaccgcgcacttacattgggacgcccaggcagaggcaagactcgcgcgctcctaagccgaggcaggtcagcctaggcgcctggctgctggaagagtccattagggatggccaaggcagggtgttcccgacgccagagcgcggacctggctgcccgctgcggagagcagagtgcgcagcccggggcggccacccccgctccgctggtcaggtgagcgctgccccgggagccatgggtcctattggagcagagcgaggatgcagagggaggaggcaagggagggggagaaaggggaggaggatggagccctcctcctgatcctgtagtggtagtaagaatcagcagcgcgggcaaggagtacggacgggagtcagaggcagagcgagggtgtgtggagggccggcggggaccgccgggagcgcgcggatgtcggtgttcctggggccaggtaggctatggctgaggggtggtgctgcgagcatcgctgagccccaggggagcgcctcagcatcagcacctgttgctgcaggtgggcggcgagggcggcgcggagggcgggccacagccgggcccagggaggctgggcgcgcacccggcgccgcggcctgcgggtaatggggcatagctgcccgcgtcggttctgtccaaggctgcggttttgcagggagcgttaggttcctgcaccccctacccgccctttccaaagatgtctgatctcaaagaaggtgagaagtgaatgagcagagtgaagagtttattttcttctttttctgcctgtttgaaaccggaaccctacctagctttgattttaaagtcttgctgaaaaataacagaccaagaacggtgcgccataggtaataattgataatgggaagggtgagataaacttaaggagacttgtttgtgttccaaaataaccactgcgtcgaagaatttcagtgaaatatattgattttagggagcttgggattaacatggagctatagaataatatgtatatgtatatatatttaaaaacttacaaatttttaattttaaaaactgtctcaaaattgatttttttcttaaaatcaagaaattatagcagtgttcgtcaggggaaaattgattttaaggtgtgttaacttatcctatgtaacttgttttaaaccaacttttcccacttcatgaaatccacagcctttaaaatgtgtgtaatgtatttactagtatgctatacactcttttagaaactgatatcaaattttaaagatgcataattactgagaattaggatgaaagtcaaaaatataccttaactcatacagcatgattagaaattcttactgaagttatgattactttaaattactaaagtgttttttctccctttgtgtgtcatttatcaaaataattagatcaaacaacaacaacaacaaaaacccccaaaagatcataaggaagagaaaaaatgatatcttaggcaggatacaaatgagcaccaataatttattctgggttaatttcatagagtaagtggcgaactattccgcctatataatttgagaaaaatgtaggttacagggagatgtcaaatagactctgaactgtgttataataaaatatattaaatatatgtgattaggtataattttctggctctgccattaacacacaatgacttcggacattcacccatccttccaggcattagtttcttcatttataaaataaagtaattggactaggtgattgcaaaggtttatttcagctaaaaatattatatctctcaaattattacttttagaagaagtaaccaagatacacagactttaaaaatttacaactgaagtacgactgaatcctatctccattttctcatttccatgatgaataaatatagcagtcactccttaatgaatgcctgctatgtagtgaattcttagaaaccctttacataggttatcttatttaacacaataccaccataaattgaatagtagtatatcccaatttatagataatgatactgaagaatgaaaagtttaagctccttgcccagagttccagtttataagaactgggtcaaatattttttccaaatgctcttaggacctatactatactgaatgggatgattaaaagctaaaattgcctataaactgaagtaatcttggactactataagagtctataatggggcaaaggtaaattatgtaacactgagtcttcataccattaaatatataagtgctgtatcagtctccatttattatatcttaaaaagttacatatttatgctgtatatttattaattgaatgccagttgtattctcagaaagtgatcatatgagatatatttgtaacacaaatggttttatggtaataaatataactgctagaaaaaatgtgagagggcagaagctagtattaagcaaatgctggtattaagtatgtcagatgtctttctacttgaaggtactcatgcttgagacaaaaatgcttacacccaagggaaaagggtgttcagagtagaattagctgtgactaaactcttttgttcatatcctatgatgaatcataatagtatgtcacatttattgaatatacgttgtatgccaggaattctcttaagccctttattagtataattttatattggatcatgaattaaattgtattatcctgatttgcaaatgaagaaaccgaggcagagagatctatgccctgggaggacccacaaaaaaatactttttatcttagattaaatgtgtgatcgttcattgttctgaaattcttaggctgtgaatgtaacatgaaatcttgaagcactggaaggagacttggagccaaactaaaccaacctctttattttatatttgaggtaaaagagacctagaacagttaagagacgcacttaaggccacatattttagtcacctatacattctcataaactattaggtaagaagtatcctaatgggtaaacttggttattaattgtttgatttattgtcacgcaaacaaatgccacctcatgccgtttcttatattgctgccctacttttatttaaaatttcaaggttgccccaattaggatgcaaaatccttgaagacagtgattgtattatatatttctcttatatagtatctatagggttcagcatagtggttaacctattgaataagttgctttgttgcctgtttgcctttgataagtcattattttatgcaccaggtctgaaatctacacagtggaagcacaatgccatcaccatttttcacttcatgtagagggcaactagacaatttatgatgcttacaaagtgtaatgagcttcttagataattatttaatttggttataaaatgcagtgtgttaccatggagagatttggatgtgtatttccctgattttggggggacaaattgcatagctaagtatcacacacagttcaatttacctccccaccactctgttcttttgatttggaaataacttttttttctgagtgcaaagataatgcaaagtcatgcaggaaattcagacagtaaagaaataatgaaaaaatcaccagaacctccccagtctaaaggttttggtgaacagccagccagagaggtctttcttctcttaactcctgtcgaatcagggtgagagctgaattatttattgaaaccatttacagtaaagttctatttagttttagtattccattactcctgggcagttcagactttatgtaaataaagatatttgttgagcaatgaagataaacatactactaataaactagagtctactccatgtagaatggagtagtacagaaagttgatttcctcacatcgtatgcctaattttttcctttcacaaggtaggtttgggagcacagggagcatcttttgcatgcatggagggttctccaatatgccaggatcttaggccacacatgaagccacagcaccccagctctgttgccctgagtgaggtgtggcagaggaggagaagggtggagctgaggcacaagcggctgtggtaatacaaaggctgtgttttccgattctactgtgacacactatacacttaaaaatgtaccagaccaagtccctccccgagctgctgggcaggtggtcatggggcccttttctggtgcagtcacgcgtaagtctggctttacctcaaagccagggcaagatgctgatagggcatttctcattcatttattcaggattctgaaaacctagaatggaccctcttttatattaaagggaaacactggctgctggaatcattgtccataaatgagtcttgaagtaatactcacaaaattattaagtataaagaaaagttggggcatctctttgagagagacaatagctctttctgtatgcattcggatgtaattacattgaaaatatttgttttgaagattatgttttctggttattttaatttcataaatctatttgttattcaaaacttctttccctaggcatattttctttgtttatactatacatttgagcagagagatttttcatgcttcactttattaggggcttaacatggctttaatccaaccatctgttcgcatcttggcacatcagcatgtctgaggtgctggtaggggccaaataaatttcccacattttaaaggttagggaaagagctacctttatgaatagatttcaaatgattctcagcaagacaatggtatagaagtggagtaaaaatgcatttcattctctgaagcacaaggtcccctgtctgtcttcagttttgctgaaaggcaattagcatttcaactagccaatttggttacatgcaacgaagtacttgggtttataatttgctgctctgtctgaggctgttgagtgctaggtcttatgtaatcctttccaagtagccttctctccagcatagttattgttgctggtcttaaataactaatcaacagagagttttccttgccttcaactgtagggtgccatagggcaaggaaaatgaaataccaagcaaataaggggatgactgtaattataaatagtcattattgaaatgtggcacaggttgaaagacatacaatagcttcaaataaaatgcaactccaaaaagtcattgtgtgcactgttaatggtttctcatgcagtatgcacaataagcatagggcatacatgctgggattaattcagttaacatgactcaaaattaacaaagaaggtgcaattcctttatgccagaaagaattttgttgggaataggtttaaaagagaaaagattctaaagtgttacaacaaatgaataagtgctctgaggcatattgtggaaataaaggttttgtactgtgtgctaattgaaaataagatttttgtcagcttctttagtcgtgaattttgacaattaggtagtattaatatacttcatgtatacactcatatttctctgaaggagccactgtatggtatggtaatccttttgttaggataattaggatgatattttcctgtaatccatgtcatggaccagcaattcagtgtagctcatcttttggtgtaacactgtttttgcatagatgtacttgtgtaattatttggaggtaaaatagtacatttttcattcttcaagtaatgtttaactgaaagaaggcataatagaaagaagtgttttagatatgtcttacaagtgatcagtataattttgagaacatatgtgaaagaattgattttcatttatatttccaatctgcgattataaagcttttgttacggttatagttagaatcattagttttatttaactaatttcaacagtgttgatgagcaggaatgaaatgaagagagcttgttccttctctggcagactagtaagctaaggttggagagtgttctggaaaaagtgggacttgattgggactttgaaaaatggtggaagagagggagtggaaaaaggtagagaggactgggactagcttagattaaaggtgcagaagcatgaataatacaagtgttttgtcccagacacgtattagattaacctggctggaaatgttgaaagaagagaaagagatagctggaagtgcagaggtttgattgttttttaaattgatagataattcacatatgaaaaacaatcacctttcaaagtacacatttccatggcgtttaatatatatatatatttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccactgcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccggcgtttaatatatttaaaaagttgtggcctgggcgtggtggctcactcccgtaatcccaacactttgaaaggccaaggtgggcgggtcacctgaggtcaggagtttgagaccagcctgaccaacatggtgaaaccctgtctatactaaaaatccaaaaaaattagctgggcgtgttggcgggcgcctgtattgccaactacttgggaggctgagtcaagagaatcgtttgaacgcgggagacagaggttgcagtgagctgaaatcccgccactgcactccagcctgggcaacaagagcaaaactccatctcaaaaaaaaagttgtgcaaccatcaccactgtctattccagaacattttcatcacctccaaaagaagctctctacccattagcttttgctctctatcccacctttctccactgccttccaattcctggaaaccagtaatctattttctatctctatagatgtgcctattctgggcattttgtataaatggaatcatacaatatgtggccttttgtgtgtactttcacttagcatgatgttttaaagattcatccatgttgtaccatgtagcaatacttcaatccttttgtaaatgccaaataatattccagagtatggatatgccacctttcatttatgcatttataaatagatgggtgtttgcattggttttactttttgactattataaataatgctgctttaagcatttgtatacaagttttttttgtgctgacataagttttttgttctcgtagtggcccatctaggagtggaattgctaggtcatattgtcaccctgtgcttcattttttgaagaatttccagctgttttctaaagtgtgtttaccattgtatatgcccaccagcaatgtatgagagttttgatttctctctgtctttttatgttaaccatcctattcggtgtgaagtggtatctcattcgggttttgatttgtatttccttaatgactaatgatgttgagaaccttttcatatgcttgttggtcatttgtgtatctcctttggagaaatttctattcaggttttttgcccattttaaaaataggattttgtttttgtttttgttttttattgagtcataagagttcttcgcatactctagatactaatcccttatcagatatatcatttgcaattttttttcattgtgtgggttgtctttttactttcttgatggtgtcctgtgaagcaaaatgtctttaattttgttgaattaatttatttaactttcctttggttgcttatacttttggtgtcacagctaaacaactgttgcctgatacaaggtcacaaaaatttatacccatgctttcatctaagagttttatagtttaagcttttacatttaggtttttattccattttgtgttaatttttaatatgatataagcttccttcatttgcacatagatatccaattatccaggttccatttgctgaataaatcattcttttttcattgaattggctaggcttcactgtcaaaaattaattgactataaatgtatggttttatttctggactcaactctattttgttgatctagttttctgccagtacctcacagtcttgattattttacatattttgttaaatttcttcctaagcattttattgttttattaattatgttgtaaatgcaattattttcttaattttatttttgaattcttcattactaatgtatagaaataacaattgattcttgtatattgattttgtattctgtaatcttgctgaactcttttatttttttatgtatggtgtttttaggattttctatatacaatatcatgtcatctgtagatatagtttaatttatcttttccaaggatacgttttattttttttcttgcctaattgtcctgcctagaacttccagtaaagtgctgaatagaaataatgagagctgagatccttgtcttgtcctgtgatcttagagagaaaacttttggtctttcagcattaagtatgatgtggatacccattatagataccctttgtcagattggagaattatccctttattcctaatttgtataataaaaagatgttgatttttttcaagtgctttttttgtgtcttttgagatgatcatgtgattccctctgctttttttctattaatttggtacattgcattaattggttcttgatggtgaaccaatgtagcattcttggatagatctaatttggttatatagtgtatcatttgttttatatgttactggatttggtttgctagtattttgttaagagtttttgtgtcaatattcataagggatacttgtcttagtttttttcttggttctttttttccataatgtctttgtctggttttagtatcagggtaatactggccttataaaatggtttgggaagtcttgtgttttatatatatatttttaagtttgtgaagggttgatgttaattattccttaaacatttggtagaattcaccagtgaaaccatctggtcctggactttcttcatggtaagttttgcaattactaattcaatctatttaattgttgtgggcatattcagatttttaatttctttttgagtcaattttggatgttcgtatcttcctagggatttgtttacttctaggttatctagtttgttggcatgtaattgttcatggtcatgctttatatactcagttttatttctgtaaagttggtagcaatgaccccttttgaatttctcattttagtaattcaaatcttcttcccttttttcttaatctagccaaagttttgtcagttttgttatcttttttttttttttgacagaatcttggtctgttaccccggcgggagtgggagtgcagtggtgcgatcttgtctcactgcaacctccgcctcctgggttcaagcgattctcctgcctcagcctcctgagtagctgggattacaggcacctgccaccacgcccagctaatttttgtatttttagtaggacagagtttcaccatgttggccagctggtctcaaactcctgacctcaagtgatccacccgcctcggcctcccaaagtattgggattacaggcatgagccaccatgcccagtcccttttattatcttttcaaagaaccaacttttacttttgttgattttctctgttgtatttctattctatattttatttgttcccactcaaatattttttctttgtttccttctgcttgatttgggtttagtttgcctgtttttttctactttcttaaggtggcagtttaggttctttatttgagatctttcctttttttaatatatgcatttgtgcctgtaaattctcttccaagcattgctttaggtgcatcccataagttttggtatgctctgattttattttcattaatctcaaattattttctaatttacatgtgctctcttttttgatcctttggtcatttaggagtgtgctgtttaatttcaacatgtttgtacattttgcacttttttctgttattaatttctaatctcattctcttatggttggagaatatactttgtatgattaaagttctttaaatttattgagacttggtttaggaccttacatattatctcttctggagactgcttcatgtgtacttgataagatatgtattctgctgttgtggggtgaagtgttctatagatgtgtattaggtctagttagtttacagtattttttaactcttcccttttcttgttaatcttttatttagtcgttatattcagtattgaacatggggtactaaagtcactaactataattgttaaattgtctgtttttcccctcaatttggtcagtttttaattcatgtgttttgggattggctttttatgtgcctgtaggtttacaattgttacatctttctgataaattgagccctttatctttataaaatatccttctttgtctgtagcaacattttctgtcctaatgtctattttgtccaatattaatgtcttagtccattttctgaataccagagattgggtagtttataagcaatagaagtttatttgacttacagttttggaggctggaaagtccaagaacttggctctggtatctggcaagggcttttgtgctatgttattccaggatggaaagttagagggcaaacaagcatgtgagacagagaggggaaattagaccaaacttatccttttatcaggaggccactcctgtgatgactaacccacccccctaatagcagtattgttccattcatgagggcaaagccttcataatgtaatcacctcttaaaggtcctacctctcaacaccgttagttacaatggcaattaaatttcagtatgagttttggagaggtcattcagaccatagtaatgaatatagtcacttcagctttcttttggtttctgtttgcatgatatatatatatatatatatatatatatatatattttttttttttttttttttttttttttctcattcttagtttcaacctgtttgtggctttgagtttaaagtgaatcacttataaagagcatatagttaggtcattttttccaattcattctaatgacttctgccttttaattggagtatttaatccagtaatatttaatgtaattactgataaggtaggattgatgtctaccattttgctatttgttttttgagtctatgtcccttttcatcccctgttcctcttttactgccttcttttattttacatagatattttctagtgtatcattttaattttgtggttgtttcttttattatattcttttcattaattttattattggttaccctggggattacatttaatatcctaacctataataatctagctcagattaataacaacttaatttcaatagcgtgcaataattttgctcctatatagtttcatttctgcccctgctttgtgctgttattgtggtacaaattccttttttatacagtatatactctttagcacaaatctattattattgctttatgtagttgtcttttcaatcagagaggctaaaagtagttataataaaagtacatttatgccatcttttatatttatctgtcatgtgaccttttctggcactttacatttttttctgtggattcaagttactctctaatgttctttcatttcaccctgaaagactccttttagtatttctggaaaggaaagttgctaaccacatagtgtctcactttttgtttatccaggaaagtcttaatttcttcttaattttggaatgacaattttgttgcatatagtatccttggtttattgtctttcagcactttgaatacatcactgccttctagcctcctaggctagaggagaaatcagatattaatcaggatatcacttttatgtgataattttcttcttccttcctctttcgtgattctctctttgtcttttgctttggcagtttcgtatatgtctacatgtggatctctttgtgtttattttacttagagtttactgagcttcttagatatgtagattaatgtttttaaatcagatttgggaagccttcagccattatttcttcagccatatttctttaactactttctgttgttagtcttcttctgggagttccactaggtctatgttggtatattttgtggagtcctataggactctgaggctctgttcatctttcttccttattttgtctttttgttcctcagcctgggtaatttcagttactttcatgttcactgattcactcttctggctgcttaaatcagctgttgagcccctctgtgaatttctcaatgtagttattttacttctcaactccagatttctgttttttttttttaaactatctttttgatatcattcatttgatgagaaatcatttttatactttttattgtttatatagacatgatttcccttagttctttgaatatatttaaaacagttgatacaaagtctttgtctagtaagtctaacatctggtatgttctccagggacagtatttatcgattacttttttcctgtgtattgctcatattttcttgtttctttccatgcttggtatttttcttttttaagaaactgtatggctttgaagttcagattctccctcttcctagggtttgttgttgtccctgattttattgttgtttgtttagtgaattttctgaagtctttttaaagtatgtactctttgttatgtgtggccattgcagtctctgcttggttagcttagtggtcagctaatgagtggacagagattttcttaaatcctgggaaacagtaagtctcccagtttttgcttgggagctccatgtgcgtgttgaagaatacctttagcattcagccagaaaattttcaactctgcctaaccttcacttcctctttgcacacagcctcaaaaccagccagaggtgagaatgtagggcttttacaggtttttcatgaacatgtgcacagccttatacttgtgtgtcatcttctaggttctaggaatatgtcagaaatttttaaatttgcaataaatgtctcattgcccagtctttccttttaagcttttagttagcttattgttttcccagctgttatctattacctctggcagctattatgttacataattgtctataaacatttttgacaagtgcctctaaggaaaaggctttcaaatactgggcaaactttgagtcaggtcaaataaagatactgtggtgagtgaagtcttcaagaaaccactagatagatcaaacaatgacaactctgtgaattgggctttgatggctttcctaccccattctgttcccttcagtggctgccaggatgctggttttaactgttattgcaggctgttagtttttaaggtgactttggaggctgggagagttgtgtgggaataggtcaagtttaaatgtaataaagttcactgatttcctggagattcagctgtatttctttaataaatgctccttggaatcctgcaagcccttggttaatttctgaagttctgcaagcattgattctgacagtttttgctagttttctcattatttttatggagcagaggattttaggaggtccttaccctgacatttgcactggtttggattttcagagcaaacattagggcttccccctacctcttgttagatattatggaatcactgtcagtttttgaactacagactgatataaaaatagtcttttgaagactattctgttggtaatgtagagaaggctgattggaatgggcagaagagagcaaattaataaaggcaataacagtggatgtatgttgataagctcttgttttgggtagcagcaaaacaatgttaaatgaaggataaaggaggcatttaaagagggtgtcagaagtacttggtgaccttttgcatgacttctgtatttaagcaggtttgatgtcaataatataaaataaaataaagtaaaataaaataaaaaagttcttctgaagaatatgtcatccatccagtcatccattcattcaccaaatacatgtgaatgaactggtacgaaagcagaaacaaagaccaatggaacaaaatagaaaacagaatagaaataaaactgcacacctacaaccatcttatctttgacaaggccaacaaaaacaagcaatggggaaaagactgtctattcaataaatggtgttggtataaatgtgcacacatgctcacacacgcacacgcacgtgcacacacacatgaattaacaatatctaacaaattatgctttgatggatgtagagaaaaaagagtgaataattttcaaaggaaaaaagttgagaccgtaggatacgtgttttgggactagccttggaaaagggaaggatctcctgtactgtgagagaggagaaaataaagtaattgggggaaattggaattagaatggactggataggaggaaggatacgtcagagaatgtattcatgcccttcctcacctaccaggaagggtggataaaacagacaggtggcatttaaaaggaatttgtccccattcttctgtatattttgttaaactcaggatcaagttatggggcaaatgcatcacagatggcttgaaggtttcccttagatctctccgtgtatagatctactaattaagtaagaaatttaaggccaccagattgtgaggaaacacaataaagtaatgctttccaattcagtttttcccttcagcactgggatgtagcttttcctaagaaaggaagtatggtattggttggcataatgattgagctctccaggatattgctaaaatcagaaatgtggttgaatattatctgattcccactgaatccattccctgatggcttctgtctttttggtggagacttatctaaattacagtcatgcattgcttaatgatgaggatatcttctgagaaatgtgtttttaggtgattttgtcatcatgcaaacatcatagagtgtacttacacaaacctagatggtataatgaaccacacagctgggctatatgtatatcctatggctcctaggctaaaaacctgtacagcatgctactgtattgaatactgtaggtaattataacaccaaggtaagaatttgtgtatctacacatacctaaacctagaaaaggtgtagtaaaaatacaatattataaccttatggaccaccatcatatacctggtccatcactgactgaaacatcattatgcagtctatgactgtatgttggatgaactgccaaaatgagaaataaattattgttttcttctgagacaaattattgaagttttaaaatgttgtttttttaaatgagagaaatttaataaatcacttgattgagaactgggcattaagtaaaaattaagtcccatttaccaaagcataatttgtcagatattgttcattcatgtgtgtgtgtgcacgtgtgcatgtgagcatgtgtgcatgtttataccaacaccatttattgaatagagagtcttttccccattgcttgtttttgttggccttgtcaaagatcagatggttgtaggtatgcagctttatttctattctgttttctattttgttccattggtctttgtttctgcttttgtaccagtaacaagctgttttggttactgtggctttatagtatagtttgacatctggtagtgtgatgcctccagcattgctctttatgcttgggattgctttgtctattgaggctctttttcggttccatgttaatttcagaatagttttttttttttaaattctgtgaagaatgatgttggtagtttgataggaatcgcattgaatctgtaaattgctttggtcagtatggatgtttttatgatattgtttctttcaatccataagaatagaatattttttcatttgtgtcatctgatttctttcagtaatgttttgtagttccccttatagagatctttcacctccttggttagctgtattcttaggtatttcattttctttgtggctattataggtgggattctgttcttgatttaactttcagcctgaactttgtgtatagaaatgctactgatttttgtacattgattttgtatcctgaaagtttactaaaattgtttatcaattctaggagcctttttgtggagtctttaggattttctagatatagaatcatatcgggttgacgccagcttcatagagtgagttagggagaagcccattctcctagatttttggaattagtttcagtgggattgatatcagttccttgtacgtctggtagagttcagctgtgaatccatctggtccaggatatgttttggttgttaggttccttatcactaatttaatttcagaagttgatagtggtctgttcagggtttcaagctcttcctgattcagtcttgggagattttgtgcttgcaggtgtgtatccttttcctctagattttctaatttgagtgcatagagttgttcatactaggctctgaggattttttatatttctctggaatcagttgtaatataacttttgtcatttcagattgtgcttatttggatcttctctttctgtttctttgttaatctagccaggggtttatcaattttatttattttttttcaaagatccaatttttggtttcattaatcttttgaatgaattttgcatcttgattttgttaagttctttaattttagttatctcttttctgtgggtagctttgggattggtttgttctttttttcctagttttttttaggtgcaaagttatattgttgatttgagacctttctaactttttttttacttttaaaaaagacattttattttattttattttgtgttatgttattttattctttgagacagagtctcactctgtcacccaggctggagtgcagtggcatgatcacagctcactgcaacctttgcctcccggattcaagcaattctcatgactcagcctcctcagtagctgggattacaggtgtatgcatcacgcccagctaatttttgtatttttagtagagatggggtttcaccgtattggccaggctggtaaaaagggatattttaatacaaaggaagtagtcaaagaattctgagctcagattgcaggatggcccttttcaaacagaggcagctggccgcttaccttgccttcattttccaggggtttctcctcccatgaatggacagcgaaagcttcatcctagaccaatcctgtctccacgatggctttggggacctgccttgccccagggttttgtctacaggcctggcaactttgaccatgagaggcagactccctctaactggaggctgacaagtggaaactgttcggattattcccagagggcttacatgggggcgggtcatcctggtgaattctcaggcatgatccaaatctgcctcctaggcacagaacaccattctccagggtcgcagtgctgcctggactccaggaagccagtctctgctgctcctggtgtgcccctaggggtggccgaggttagtaaggcctcccctcactggagcagaagacaaagtgatttatcttgatccctgtgaaatggttgcacaaccccaagagcctgagactcatcaaagaatgtccctctttatttcctgttcattacattgccatgcgcaattcagacaagacatcccagcactgcttccagtcctctgcttaagggtgggattctattattattattatactttaagttctagggtacatgtgcacaatgtgcaggtttgttacataggtatacatgtgtcatgttggtttgctgcacccatcaacccgtcatttacattaggtgtttctcctaatgctatccctcccccagccccccgccccacgacaagccccagtgtgtgatgttccccgctgtgtgtccaggtgttctcattgttcagttcccacctatgagtgagaacatgtggtgtttggttttctgttgttgtgatagtttgctgagaatgatggtttccagcttcatccatatccctgcaaaggacatgaactcatccttttttatggctgcatactattccatggtgtatatgtgccacattttcttaatccagtctatcactgatggacatttgggttggttccaagtttttgctattgtgaatagtgccgcaacaaaaatacgtgtgcatgtgtctttatagtagcatgatttataatcctttgggtatatacccactaatgggatcactgggtcaaatggtatttcttgttctagatgcttgaggaatcgccacattgtcttccacaatggttgaattaatttacagtcccactgaccaacagtctgaaagcgttcctatttcttcacatcctctccagcatctgtttcctgacttattaatgattgccattctgactggcatgagattgtatctcattgtggttttgatttgcatttctctgatgaccagtgatgatgagcattttttcatgtgtctgttggctgcatcagtgacttcttttgaaaagtgtctgttcatatccttttgaccactttttgatggggttgtttgttttttttcttgtgaatttgtttaagttctttgtagattctggatattagccatttgtcagatgggtagattgcaaaaattttctctcattctgtaggttgcctattcatgctgatggtagtttcttttgctgtgcagaagctctttagtttaattagatcccatttgtcaattttggcttctgttgccattgcttttggtgttttagtcatgaagcccttgcccatgcctatgtcctgaatggtatgctgaagttttcttctagggtttttatggttttaggtcaaacatttaagtctttaatccatcttgaataatttttgtataaggtacaaggaagggatccatttttcagctttctacatatggctagccagttttcccagccccatttattagataaagaatcctttccccatttcttgtttttgtcaggtttgtcaaagattagatggttgcagatgtgtggtgttatttctgaggcctcttttctgtgccattgatctatgtatctgttttggtaccagtaccatgctgttttggttactgtagccttgtagtatagtttgaagtcaggtagtgtgttgcctccagctttgttgtttttgcttaggattgtcttgacaatgtgggctcttttttggttccatatgaagtttaaagtagttttttccaattctgtgaagaaagtcagtggtagcttgatggggataacattgaatctataaattactttgggcattatggccattttcatgttattgattcttcctatccatgagcatggaaggttcttccattagtttgtgtcctcttttatttcgttgagcagtcctttgtagttctccttgaagagatccttcatatcctttgtaagttggattcctaggtattttattctctttgtagtaactgtgaatgggaattcactcatgatttggctctctgtctattattggtgtatggaatgcttgtgatttttgcacacggattttgtatcctgagactttgctgaagttgcttatcagcttaaggaaattttgggctgggatgatggggttttctaaatatacaatcatgtcatctgcaaacagagacaatttgacttcctcttttcctgattgaataccttgtatttctttatcttgcctgattgccctggccagaacttccaacactatgttgaatagaagtggtgagaggggcatccttgtcttgtgctggttttcaaagggaatgcttccagtttttgcccattcagtatgatattggctgtgggtttgtcataaatagctcttattattttgagatacattccatcaatacctagtttattgagagtttttagcatgaagtgctgttgaattttgttgaaggccttttctgcatctattgagataatcatgtggtttttgtcgttggttctgtttgtgtgatggattacgtttattgatttgtgtatattgaaccagccttgcatcccagggatgaagccgacttgattgtggtggataagatttttgatgtgctgctggattccgtttgccagtattttactgaggatttttgcatcgatgttcatcagggatattggtctaaaattctctttttttgttgtgtctctgccaggctttggtatcaggatgatgctggcctcataaaatgagttagggagaattccctctttttctgttgattggaatagttccagaaggaatggtaccagttcctctttgtacttctggtagaattcggctgtgaatccgtctggtcgtggacttttttggttggtaggctattaattattgccataatttcagagcctgttattggtctattcagagattcaacttcttcctggtgtagtcttgggaggttgtatgtgtccaggaatttatccatttcttctagattttctagtttatttgtgtagaggtgtttatagtattctctgatggtagtttgtatttctgtgggatcggtggtgatatatcattttttattgagtctatttgattcttctctcttttcttctttattagtcttgctagcggtctacctattctgttgatcttttcaaaaaaccagctcctggattcattgatttttttgaagggtgttttgtgtctctgtctccttcagttctgctctgatcttagttatttcttgccttctgctagcttttgaatgtgtttgctcttgcttctctagttcttttaattgtgatgttacggtgccgattttagatcttccctgctttctcttgtgggcatttagtgctataaatttccctctacacactgctttacgtatgtcccagagattctggtatgttgtgtctttgttctcattggtttcaaagaacatctttatttctgccttcattttgttatttacccagtagtcattcaggagcaggttgttcagtttccatgtagttgtgtggttttgagtgagtttcttaatcccaagttctaatttgattgcactgtggtctgagagacagtttgttgtgatttctgttcttttacatttgctgaggagtgctttggttccaattatgtggtcaattttagaataagtgtgatgtggtgctgagaagaatgtatattctgttgatttggggtggagagttctgtagatgtctattaggtccacttggtgcagagctgagttcatgtcctggatatccttgttaaccttctgtctcgttgatctgtctaatgttgacagtggggtgttaaagtctcccattattattgtgtgggagtctaagtctctttgtaggtctctaaggacttgctttatgaatccgggtgctcctgtattgggtgcagatatatttagtatagttagttcttcttgttgaattgatccctttaccattatgtaatggccttctttgtctcttttgatctttctttattggtttaaagtctgttttatcagagactaggattgcaacccctgctttttttttgctttccatttgcttggtagatcttcctccgtccctttattttgagcctatgtgcatctttgcacatgagatgggtctcctgaaaagagcacactgatgagtcttgactctttattcaatttgctagtctgtatcttttaattggggcatttaacccatttacatttaaggttaatattgttatgtgtgaatttgatcctgtcattatgatgttaactagttattttgcccattaattgatgcagtttcttcacagcattgatggcctttacaatttggcatgtgattgcagtggctggtaccgattgttcctttccatgtttagtggttacttcaggagctcttgtaaggcaggcctggtggtgacaaaatctctcagcatttgcttgtctgtaaaacttcctgttggggaagttctcctggataatatcctgaagagtgttttccagcttggttccattctccctgtcactttcaggcacactaatcaaacgtagatttggtcttttcacatagtcccatattttttgaaggctttgctcgttttattttactcttttttctctaaccttgtcttcccgctttctccttcacttagtttggctggatatgagattctgggttgaaaattcatttctttaagaatgttgaatattggctcccactctcttctggcttgtagggtttctgccgagagatccgctgttagtccgatggacttccctttgtgggtaacccaacctttctctctggctgcccttaacattttttccttcatttcatccttggtgaatctgacagttatgtgtgttggggttgctcttctggaggagtatctttgtggtgttctctgtgtttcctgttggggaagttctcctggataatatcctgaagagtgttttccagcttggttccattctccctgtcactttcaggcacaccaatcaaacgtagatttggtcttttcacatagtcccatattttttgaaggctttgttcgttttattttactcttttttctctaaccttgtcttcccactttatttcattaatttgatcttcaatcactgttatcctttcttccccttgatcgaattggctattgaagcttgtgcatgcgtcacgaagttcttgtgccatgtttttcagctccatcaggtcatttaaagtctcctctacactgtttattctagttagccattcgtctaaccttttttcaagtttttttagcttccttgcgataggttagaacatgctcatttagctcggagaagtttgttattaccgaccttctgaagcctacttctgtcaccttgtcaaagtcattctccgtccagctttgttccgttgctggtgaggagctgtgatcctttggaggagaagaggtgctctagtttttagaattttcagcttttctgctctgatttctccccatctttgtggttttatccacctttggtctttgatgttggtgacctacagatggggttttggtgtggatgtcatttttgttgatgtagatgctattcctttctgtttgtgagttttccttctaacagtcaagtccctcatctgcaggtcaattggagtttgctggaggtccactccagaccctgtttgcctgggcatcaccagtgaaatattgttgcctgatccttcctctggaagctttgtcccagaggggcacctgcctgtatgaggtgtctgtcggcccctactgggaggtgtctcccagttaggccacacggggctctggcacccacttaaggaggcagtttgtccattctcagagctcaaatgccgtgctgggtgaaccactgctctcttcagagctgtcagacagggctctaacttcttgataaaggtgttttaaggctattaagtttcttcttaacactgctttggctgtatcccagagattttggtaaattgtgtctctactctcattagtttcaaataatttttacatttctattttaatttcaatgttcacccaggagttatttaggagtcagttgtttaatttccatgtattgtgtaatttggagcggttttgttggtattgcttttcatttttattgcactgtggtccaagagtgtacttggtatatgatttcagttgttttttatttattgaggcttgctttatgaccaagcatgtgttttttttttttttttggaatgtgttctgtatgcagatgagaagatgtatattctgtggtcgttgggtggagtgttctgtagatgtatattaggtctaattgctcaagtgttaagcttaattccagaatttctttgttaattttttgcctcaatgatctgtctaacactgtcagtggaatgttgaaatctcccactatttttgtatggttgtgtaaagtcttttcttaggccaagaagatattgttttataaatctgggtgctctagagttgggtgtgtatatatttaggatagccagagcttcttgtcagattgtaccctttatcattctgtaatacctttcattgtccttcttaacttttattggtttaaagtctgttttatttgatataagaatagtgactcctggtctttttaattttctgttattgataaatcctactccactcttttactttgataaattttttttagagatgggatctcactctgtcacccaggctggagtatagtggtatcatcattgctcactgcagccttgagctcctggattcaagagattatcctgcctcattctcccaagtagctgggactatcagtgtgcaccaccatgcccagctaattaaaaaacaaaacattattgtaagatatggggtctttctgtgttgcccaggcttgtctcaaacttgtcttcaagtgatcctcctgctttagcttcccaagtggctgagatcacaggtgcaaccctccatgcctggcttagtttaaaatgaattcacttcgtatcttaaattttctaatataaataaatgtacaatcataaatacatctgtattaggtattttcattgggtagtgttaaattgaaaacatcactataataaatatatttctaaaacttatctaggatttatttttctaccaaaagtataaataattggaaacaatctttgagtattattgtaaagcaatttgatcattgtgtggcagttttatatagtatttaagtagtaaagtcgggaaactttggaaattgttcatgctttcaggtgactagaatgccctagcttttataagtcagtagcatacctagtagttgagaccttagtataatatatgattaatagactttcctgaagctttttagcttccgagagactttacttcatctcatttttcatttctcagtaatattcatgagtgatatatattaggaattggtcattaattcattctttttttactgaagcactctaacatgagtttgaaaaaaacattgagctggcaatttctgctttcacattttattacagcctcaaaacttgttttataatgatttttagtgatattttaacatctttatgatttcatggcaccatacatttggaaattccattcctactcttctagctaccaaaaacttttccctccctcccctggcacacttctttcagcataggagatgaatgtaaccatagaattagggccccatacttgcattttttcattacttttgttctgttgaggtatcatgatagccacaaaaaacatctaggcctacaactaattaccttgcaaatggtaaatcactgtgggtttgaaattgtatgtaatatgaccattcttattacatagttaatcactaggtgtaagggcttttctattcattaatgttggaaataacagactgtgctgcccataagagactgagttggattatagagagaagagagtaaaatgtgcacgtttcatttgatggtatttttaatacgataggtgctatagatatagtgattttgaaaatgatctttcccatatgactattagtaagatttctttgttaatagaaaatgtatatttagaattttgttaagagtataagagctggactctgatggcttgggtttatatcctggccatttccaaagtgtaatttggcgaatatatttaatccctctgtaactcaggttcctcatttcacaatgggcatactaatagtacctatattatacaatattttagatggttattgggaggattaactgagtttcatgtaaagcagttaaaacagcatgtagtgcttggtaaagttagctgctattagctaatactgtgacacgtaaaattcaaattattaatgattcgggtgcctaaatgaaacttttttttccttagctcctttttcttcttctagaatcccgaagaatgtttaaatttaccttgaagctgctagagctcaagcttcagcccctaagcattttgtttttaatttttacttttcttcttgaagcggagtcccaaattatatgtatgtgctttaggcataaccaacttctctaaaaattaatgacttaaaataaccacttgttttgctcatgaatctgtaatttgggtagagcttggtggggaccacttgtctctgctgtatacagggttcttggggcagcccacctggggctggagtatccttttccaagatgtcttactcaagatggctggcaaattgatgctggctgttagttctccatgtgagccactctgtggggtgactttagcttcctcacagcatcatgactaggtgtcctgagcagtcattgagcaagtggtgcaagagaccagaagtggatgctgccagtttttaaagacttgggactgaaagccagcctgtctttgctagaagtaaatacagtattaagttctactatattttattgttcaagtggccatagaacccacgtttaagaagaggggataaacaacccaccttttaatggagaagtgtcaaaaaattttggttccatattataaaaccaccacactgcatttgctattaattaaaataataacaagcaaggtagctattatggactactttgttgaagtgtacccatttgacagaggatgtggtttctgggttactttaaaaaaggaaaaagccactttgacctcctgatgatgatatattcatacttttgttttacactggaatttcaactgaagcaccaacaaatatatcagatgtcaaaatgagttgtgagaaattatccaaacacaaaatttcaaagaatataacaaaatgagttatataacttttgaattctctcacttacattgagtgtataaaaaattcaagggtaaaatctgagagagaattttctgaggagaattttctgaggagaatttatattgggagaactgtgggggtgcatcccctgtccctctgcccctcatgtgtatctgtgcatcatcgtaagtgtggtgagaagggcttcaacaaaaccccttggagagtatgattttttgcttcaagacaatgacaaaagtcctgatctattactgagggaattaaggaggcctagggttgtaggatggagggcggagtctggataaactgtatcacctcccacagcagggcaaatggaagtgagccccagggctggctgtgaaacctgtggtaaagacgttagcctgaggtcattttaaagggatcctgcccagagggcagcctgtcaggggaaggggagcccaggagtacattgctatgggcatattgtcagaagccatattgtcagaagctgaaattgaaggagatctagattagtcagctgaaagagaagcagtcccgcatgttaggattgaagttgatgggtcctgcagtgagacctctgtagagacttaaaattccactacaatgattcagccaaggacatagagaacgaagccatcttatggcagtccagtcaaataagaacctttctaacctcttctcagttctgatcttattcaaccctcaccttgctctgtccttagtggggatgggaaaccagttggccagccgagtgaggaagaaaagtatcgacaggcaaaaagaaaagatggacaataactctttctccagctgtaagccaccagcttgcagcagtccctagttggggcagaagaagagttaatgttaaatttaagttagagctttgattattatgtggagtgtgccattaaatatttttattataaaagctttccaacatgcacaaaagtagaatagtaaaatgagcccctttttacctccgacttagaattagcaattatcaagattttgccatacttgtttcatgtatgtctacataatatagagtgcagctataaaatgtatggatattttcctacataactacagtgcttttatcctacctagcaaaactaacaataattccatagtattgttcagtaataagtccaccttcaaatttccttgattgtcttgaaaatgtctttttatagttaatttattctaattaaaatataactaagttgtagatagtttatctgacagtagtcttcttggcatctcctacccaccaaccaacagtgatttgttgaagaaatgtggcaatttgtcccatagaatgtccatgttctgaatttgtttgttctcttttttggattacttcacatgtttctttagcccccatttttcctgtaaactggaagttagctctaaagccccaattagatttaggttctgctttttgggcaagaatgctacatcggtatggtgctgtgaatttcatattgcatcacatcaggaggcacaccgtgtctggctctatcactttagtgacattgggattcagcagtgggttcaggtggtgacagctcagtcctttcattgttaagtttcccattatctttgtatctaattgtttcatccatgcatgctggcttccttgattattttactaggagttacaaataggtgcttttctaactctgtcattcttacctcattagctggaatttttctgtaaggaaaaactttttccttaacaacttggctatttggttacctggaaaaggagtttacctaggatagacaggataaatgtttaattctttccctttaaatattaatttcagagtaagtagtttgtgccctagttaccttcagtggtggccattgaactgactttctttccatctttcttttcatccctatgaacatatggatttatatattccacgtgtttcaaacaatcacattcattatccctttagatactcaaaaattttaatctttagccaatgggaacgctttcatgtttctcttgtgacgtgaccccattactcttacctggtttccttgctcaagatgttcaggtttattttgcatatttctttccccagataccagtcattcctctaaaaagtgctgcttccttgtagtggggaatgatggttagaggcaaaagtctgggcccttatgatccttattgttattgagttgtcattacttggaagtctttttagtggacagagccaggaaatatgtattttttacaaagaaaaaagtcatgacgtgatactgatatttccagtttaaatttaaccttacagaaactttacatgatttctttgatgattttattgtcatttctcttttctgtgtcttttttttttttttttttttaaatggagtcttgccctgtcatccaggctggagtgcagtggtgcaatcttcgctcactgcaacctctgcctcccaggttcaagctattcctcctgcttcagcttcctgagaagctgatactacaggtgcgcgccaccatgcccagctaattttttgtatttttagtagagatgaggtttcaccatgttggccaggctggacttaaaactcctgacctcaagtgatcctcccgcctcagccttccaaagtgctgggattacaggcatgagccactgtgcccagcgtgttttctcttaagtaattattatttgctctatcctacaaaatgtatagtttcaaaatatatatctacagtatataaaacgtggtttcaaaatgtatattctatagcataaacatttaatttcacataattatactgatattaccactgagaatatttaatgaaatataagctttctttacagctgtatttgtccttagaatttattctactaggtatagacagtgaaaatactgtattctatagccactagaaaaatttatgtctgtgctattatcactactttatattcagttgctttatttcagttatttgccagtatatatgcatttacttataaaagaaacgttggtgacttaaaacctagtagaaatgattatctatagagggaggaaaagaatgggtaaatggaagtgagcattctctgaatatactttcttatataggtttaactttggattcatataaatgtgttatatatttagaaagtaaaaatgagattaaaaaatcttcacctggagatgccaaatagtctcatggagataatgagtttggaatttaggggaagttaggaaatttttggaagttaggctggagatgtaaatttgggagacggtattttaaattacaggtgagtgaatgagaccagagtgagtctgaatgtggatgaagcagtctgagcctgagaagtgatacgtcccatgacgtagaggtcagaaagaaggcaagggttcagcaaaggaggcagaggggcttctagtgaggtgagaaggaaaaccagaggagtgtggtgtcaggaagccacaggaaaacgtgactcaagaaggaagaactgaccatgtgccctcccactcactttttgtattgctatcctttcgtatgttctaaaccacaaatgaatatctaaagagtcataagaagtagctgaagttagggaagcgggggatatttagagtgggagggtacaactctgataatgggaaagtgagtccaagtgagaagttgaagtaaaccaattcattgaaaactttaactcggagcctaactgcctccttataacctcagaattctcagctgattttgcaacttagatggaaatcaggaattaaaagagcatcaaactaaaattttcagtcagaataataagaagctaaaagtattgtctttcaagaaacacaaagagaaaaataaagatatcttctatttttttaaaggcaattgattagcctaaattttttgattgaaggaaaagacaattatcatgatagaaagtgagggtggagtgggtggtataacttcaaagtgttctgcacgctggacacattgatcaaaggcaaaataataaaagagggaagtctgaggagtcattacattattacaaaaagactccccgtatttcagtttatgacaccagagttcctaagttgaagtcaagagatgaaagataccatagttgatgcactcaatgaattctgttaatggcttccttttcacttgtgaattttcttcaaaggtaagttttaggtacaaaggatttcacagaaggatgtgaaatacatgcatgtggagggaaactggcttctctcctcaagcaatgtattatggctgagaaagaaagtgtggaatggaagaaaagtggggaatggtaaaaatacaatagatgatctgttttttgtttcaatgtctatatgcttgtgttgattaagtgatatttttgccttttttattttataaaaacatttgacatgtatgaaacatgttaaggagttccctgtttgcttatgggtggagaagacattaatctaattctaactataaggttgtaattaagccctgggtgtttatacccacaattcaagtgctagattctgggtgttaaatgatcttagttttaaggttttggttcagagttctaatttctggaattttgcttttcaaaaacagcatcagaaatgaccaaaagtaaaatatattcaatgtagaaactatggaaaacatagaaaagcacaaagaaacaccaaaattactgaaaaactctgtacctaaaggttgaccactgttcttccagtgcttttctatggatatactcacttatatacataaatatatttgtacatttttttctattttaatgtaaaatattccattttagattaacatgctgcatcatgaaactcatttaaaatataccttgatattttatgatatgacttcccttattattttaaataattataagaattaaaatgacacgttttgttgtatttcatttgaggaattcatgtgtattcaaacagcaggatcagaaacagagatattttgttatctattgctatgtaagaagccatgtccaaacttagtggcttaaattaatttacgatgatttctcacaggtctagggtttgaaggacttagctgggctcttcttccttggggtgcatcatagttgcagctcgataacggctgaggctgatgtcatcttactgcttaatcattcatgtatctgatgtctgagttgtgatgtcatatctggacatgacatgtatggatggctggaggctaactagatatgtctctttccatatagccattccatgtggctagcttaggcttcctgaaagcatggcagtcttaggtagtcagatcccttatactgtggtgccttcctctggggcaggcattccaagaggactgggcagaaacttcaaaacaacttaatgacgtagcttcagaagaccaagaatgtcacatttctactccattcttttggtttagcaagtcaccaaagcccagattcaaggggagaggacttagactccattctcaaagtgaggagcactaaagaatttgcagctacctgtaatctattaaaagtggccccatccaatttgaaagtataataatacactgttattttaatgttctgtaacaacagacatatctgtcatgttatatattcatttaaatactattactggaaaaatggcacttgtgtgtttttttaaataaaaatgctgtaatagtatttttgtattgtatttatcctacttgttacccttgaacacttcccagtgtctgtagttttcataatttttttaatttttaatttttgtggttacatagtaggtgtataatttatgggttacatgagattttttgattcaggcttgtaatgcataataatcacatcagggtaaatggggtatcatcacctcaagcatttatcctttgtcataaaatatttttaatgaggctgagcatgatggctcatgcctgtaatcccagcactttgggaggccaaggtgggtggatcacttgaggccaggagttcgagactagcctgagcaacgtggtgaaatcccgtccttactaaaaatacaaaaaattagtcaggcctggttacaagccatacttgtaatcccagctacttgggaggctgaggcatgagaactgcttgaacctgggaggcagaggttgcagtgagctgagatcacaccactgcactccagcctgggcaacacagcaagactctgtctcaaaaaaaatatatatatatattcatatttttctgatatatcacttctgaaattatgtaaatattatctactggttagataaaatagttactataataatgacaaaataattgttcactttaaattgtaggggggttaagcaaaccagtatacattataaacagctaaaataactagagatttgctaaaggaaaggcataattgctaatggctcaatgcttaactgaccactagggaattgtaaatgattgaaaaagtcaactaatccgggacacttaaagtgaattattgtgttagtagctaaaaatactttgaacctgaagtcccacttgttgaaacattcttttagtagctatggttttgttcatgtaaattgggtgaattaataagaattaataagaataacacaagttattgaatggttaacataacttaggcattgcgctaagtatattacatacattatttcagtgaatcctcacaactactctttgaggtgggtgatttaatttcacattttcagatgagaaaacaggtttagagacacaactgagatttagagatgctaagccacttgccaagctaactcagataataaggagtgattcaggatgtaacttaggtgatgtaaactcaaaacaaatgtttggactatggaaaacagtgtggagattccttaaaagtagatctgccatttgatccagcagtcccactcctgggtatcaacccagaggaaaagaagtcattatatgaaaaagatacttgcacatgcgtgtttatagcagcacaattcgcaattgcaaaaatatggaactagcccaaatgcccatcaatcaatgagtggataaagaaaatgtggtatatatgttccatggaggactcagccataaaaaggaatgaaataatggcatttgcagcaacctggatggaattggagaccattattctaagagaagtaactcaggaatggaaaaccaaacattgtatgttctcattcataagtgggagctaagctatgaggacgaaaaggcataagaatgatacaatggattttggaaagggtggtaggagggtgagggataaaagactacacgttgggtttaattagatcccatttgtctattttggcttttgttgccatttgttgcttttggtgttttagacatgaagtctttgcccatgcctgtgtcctgaatggtattgtctaggttttcttctaggaaggaacttctgcacagcaaaagaaactaccagagtgaacaggcaacctatggaatgggagaaaatttttgcaatctacccatctgacaaagggctaatatccagaatctacaaataacttaaacaaattcacaaggaaaaaacaaacaaccccatcaaaaagtgggcgaaggatatgaacaggcactcctcaaaagaagacatttatgcagccaacagacacatgaaaaaatgctcatcatcactggtcatcagagaaatgcaaatcaaaaccagaatgagataccatctcatgccagttagaatggcgatcattaaaaagtcaggaaacaacaggtactggagagggtgtggagaaataggaatggttttacaagtttgatgggagtgtaaattagctcaaccattgtggaacacagtgtggtgattcctcaaggacctagaactagaaataccatttgacccagcaatcctgttacttggtttatacccaaaggattataaaaaatcatgctactataaagacacatgcacatgtatgtttattgcggcactgttcacaatagcaaagacttggaaccaacccaaatgtccatcaatgatagactggattaagaaaatgtggcacatatacgccatggaatattatgcagccataaaaaaggatgagttcatgtgctttgcagggacatggatgaaactggaagccatcattctgaacaaactatcacaaggacggaaaaccaaacaccacatgttctcactcataggtgggaatcgaacaatgagaacacatggacacagggcggggaacatcacacatcagggcctgccgtggggtgggggctgggggagggatagcactgggagaaatacctaatataaacgacgagttgatgggtgcagcagaccaacatggcacatgtatacctatgtaacaaacctgcgcattgtgcacatgtaccctagaacttaaagtataataataattttttaaaaagagtacacattgggtacagtgtacgctgcttgggtgaggggtgtatcaaaatcttagaaatcccaccaaaagaacttactcatgtaaccaaataccacctgttctcccgaaacccattgaaataaaaaaaatatgtagtattcaaagaaaaaaaatcttttatcattaactatgatcttggtaggagtttttttttggtacaagctttttatcaaattagcaaattctcttgtattccaagcatgctaagaattttatgttttttacataactttcttgatatgtaattaaattaaaataaacttcttatgtttaaattgtacaatttgatccactaccacagatgtatacatctgcaaaaacattactacaataaaaatagtgaacatttttataatccacccctcaagcaaacacaagtgtttgtaagtctgtgtaatacgatttcttcttgaaataaaaaagtatagattggtaatttggaatatgattaggtttagggtagaagaggatgcaaaggtaaataaaatatgacacactttgttatggtgtggctgtgtccccatccaaatctcatcttgacctgtagatctcgtaatccccacatgtcatgggaggtaccaggtgagaggtaattgaatcatgggggcagttacctccatgctgttctcatgatagtgagtgagttcttgtgagttgtgatagttttataaggggttcttcccccttcgctcagcacttctctctcctgggacatgtttgctgcttcttctgccataattgtaagtttcctgaggcctccccagccattcagaaccatgtgtcaattaaacatctttcctttataaattactcagtctctggcagttctttttttttttttttttttttaatcattcttgggtgtttctcacagagggggatttggcagggtcataggacaatagtggagggaaggtcagcagataaacaagtgaacaaaggtctctggttttcctaggcagaggaccctgcggccttccacagcgtttgtgtccctgggtacttgagattagggagtggtgatgactcttaatgagcatgctgccttcaagcatcagtttaacaaagcacatcttgcactgcccttaatccatttaactctgagtggacacagcacatgtttcagagagcacagggttgggggtaaggtcacagatcaacaggatcccaaggcagaagaatttttcttagtacagaagaaaatgaaaagtctcccatgtctacttctttctacacagacacggcaaccatccgatttctcaatcttttccccacctttcccccctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcagctggccgggcggggggctgacccccccacctccctcccggacggggcggctggccgggtggggggctgacccccccacctccctcccggactgggcggctggccgggcggggggctgacccccccacctccttcccggacggggcggctggccgggcagaggggctcctcacttcccagtaggggcggccgggcagaggcgcccctcacctcccagacggggcggctggccgggcggggggctgacccccccacctccctcccggacggggcggctggccgggtggggggctgacccccccacctccctcccggactgggcggctggccgggcggggggctgacccccccacctccttcccggacggggcggctggccgggcagaggggctcctcacttcccagtaggggcggccgggcagaggcgcccctcacctcctggacggggcggctggccgggcggggggctgaccccccaacctccctcccagatggggcggctggccgggcggggggctgacccccccacctccctcccggacggggcggctggccgggcggggaactgacccccccacctccctcccggacggggcggctggccaggcagaggggctcctcacttcccagtaggggcggccgggcagaggcgcccctcacctcccggacggggtggctggccgggcgggaggctgacccccccacctccctcccggacggggcagctggccgggtgggcggctgacgcccccacctccctcccggacggggcggctggcctggcggggggctgaccccccccacctccctcccggatggggtggctgccgggcggagacgctcctcacttcccagacggggtggctgccgggcggagaggctcctcacttttcagacggggcggctgccgggcggagaggctcctcacttctcatacggggtggctgccgggcggagggtctcctcacttctcagacggggcggccgggcagagacgctcctcaactcccagatggggtggcggccgggcagaggcgctcctcacatcccagacagggcggcggggcagaggcgctccccacatcccagacgatgggcggccgggcagagacgctcctcacttcctagatgtgatggcggccgggaagaggcgctcctcacttcccagataggatggccgccgggcagagacgctcctcactttccagactgggcaaccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaaccagactccgtctgcaatccccgcacctcgggaggcagaggctggcggatcactcgtggttaggagctggagaccagcccggccaacacagcgaaaccccgtctccaccaaaaaaatacgaaaaccagtcaggcgtggcggcgcgcgcctgcaattgcaggcactccgcaggctgaggcaggagaatcaggcagggcggttgcagtgagccgagatggcagcagtacagtccagcttccgctcggcatcagagggtgaccgtggaaagagagggagagggagaccatggggagagggcgagggcgagggagagggcgagggagagggagagcgagagggagagggagagtgagagctctggcagttctttatagcaatatgagaacagactaaacacacttcttaaaacaaaaacaaaaagagtggtgggtggtctttttagttataagacaaagaataatattacaggtgatttataagagagatatgatcaactcatcttcactatgtggacacaggacagaggcagagggtagttgggaggttacacttagttttggtttgatacatgtttgagggactggtaggacatttgtttggagatgtgtagaagtcagttgaaagtgtgagcaggattggggatttatttctttaacaagaattattgccactataatcaaaagtttgccagaaacttcgaggtagctcagtggaagtgttttgatagctgacaatatgagtgttgttctgcaggatgtaaatatcaatggggaaagttgttctgtggccattatagattttggaaatattgaataaaagttgtattcttttaggcctacttagggtttgttatagactttagtaagtattttgaatatttaagaaggttatttagtatctgcacaaatgtatttcctaaatgtatttctaacagaattctttcatctgatcaaaatgtgggcataacattgcatagaccacactggggaatattggttggaacttaaatgaaaggataagagttgcactgggagacttttacagggaccaggcaaagctgagattgctcagaggacagggttaaatctgatattgaagggaaggagggagttgaagtggaagcttgaagaggaaaccaggctgagaatgggaagttgtttgtaggtaagaagagtgcattcgtgggatgaggagcaaaggagagagagaaagagggagagagaagagaagagaggaagaagagaagaggaagataaattaagaggtaaaatcttaaacatgaaagaatgaggtcagaagcatagatggtgggttattcttagagaagagtatgcatgttccatttttggagacagtctatggagatagagatggataattttgagggaagggaaataaaatcttttaaatgtttgaactattacaaaagtttaagggtggacagttaatattgatggggaatctgatgcaataatgaaagcaaataagaataaacattcttattttaaatgtatgaagatatactattcattttcagtaactattcacgcggtagtgtggagggcgtagttgggaggcaagaatagatttaaaaaggatttactttttcttaggaaaaaactcactggagatggaatcctatttaaatgccttgattttcgtcatgtttactgcggtatacccacgccttcaattatgcctggcagatagtagagactcagtgagtactttttgaatgccattgaatgatgaatgaatgttagacacagccacagcacatcaatagtgcccacatgccacacatggctttcctttaagctctttcaaacttgtgtccatgaacgaaaagactaagctcttgaaaagacttggcgctaagccctgtagccagggagagctgcttagggaccctgtgggctaaagatagcactaaagaaatggcataggcagtggagcgtttctcctctgaagaaagcacatacagagtacgtgctgacccgtgccaggagttggggctagcgaggcacatgggacacagcctgaagtagcaggcctggacagatggaggaagactggcttaagacagggcatcaggtaccggagctcagtggcagctgaagtactgtagtctgggagacaccagacctcctttaggaatgcattagccactggaattcttagagcatacaagtaggggagctccaagaggtaaaaatggatttcctgccagtgtgatgcatggcgtcttgagtaggatttaatttaatttggaaaataacggagtgctgacacatttgcaccatgggtgttgtggactagttcatacttgttacatgctagggataccaaggaattaataatcttcgttacatcacagctataagacaattttaatcaaatctatcaatctaaccctattatccctccaatcccagcagagtactgaaacacagtttgggctgcatttaaaacaaaaaaacccaccaaatcctttaagaatgagaaaagaagagaaacatttaattttggaatatgtgtaggtagtagctcatggccataaaaaacccccaaagagtagaggcttaaggtaagaaaagaaattagatggttagagtaaatgcattgagaaaaacacaggtgtacttacaaagtatgttcgtgaaagccaaaaaagtaaagccaatatagtattaggcattcacttctctgcaaagatgaatttaaatcaaacctaatgaataccttatttaaaattttaaataaaaaattttacaaaatgttttatacagctctcacccatctaaatgatcagttattgataaactcttaggcattccctaaactagaaaattttcatcccttgacatggaatttttaaatgttctgatagctgttattaacatttttatcactaaatacatcagtctgaaatgagtttaccctggagttagtgttacttctagagggtacttaacaatcttcaatggatttagcaaagagtattttcacatttggtttttacctgattgataaatgcttttgtaatcttatcaagcattatagaaagtcattaaaaattgatcttaggctttatcatctttttttttatttataaacttctgtgtaactaagaagccagagaagcccaatctcagagatttttccttagagatataagcatatcgacaaaacatcgtagcataccgagatgacatgaaatctcacaagttcaatgtgtatgaggcggatggagaaataatactgtaaagtcattggcttcaaacttcctgggatggaaatgtttgtaatccaggcttaggttttacaagtttcaaattgatggaggattgtagaagttgggggaataatagagcatgttcaggtattttggttgcaaattaaggctcttattttaatataattttgtacagtccttgaggccctgtggaaaattgttaattgaagggattgaatgtctaaaaaatattaaatatcttgttttagtttggtaaatggctcctggtagtgacaatagataatatgacacgcaaataccttgcaaatgggaaagaggtagtacttagttggaccataagtgatcttccggagctctgcctaattcatttgagcatcacatatatattttttattattatactttaagttctagggtacatgtgcacaacgtgtaggtttgttacctaggtatacatatgccatgttggtttgctgcacccattaactcgtcatttacattaggtatttctcctaatgctatccctcccccttccccccacctcacaacaggccttggggtgtgatattccccaccctgtgtccagttgttctcattgttcagttcctacctatgagtgagaacatgcagtgtttggttttctgtccttgtgatagtttgctgggaatgatggtttccagcttcatccgtgtccctgcaaaggacatgaactcatcattttttatggctgcatactattccatggtgtatatgtgccacattgtcttaatccagtctatcattgatggacatttgggttggttccaagtttttgctattgtgaatagtgcagcaataaacgtacatgtgcatgtgtctttatagtggcacgatttataatcctttgggtatatacccagtaatgggatggctgggtcaaatggtagttctagttctagatccttgaggaattgccacatatttagccagaataataaaatgtttatttttcttcatatcattggtaaattcacacaattccattttgtgtcaaaagtaataaatgaaagtgagaaccagaaaacagcacattgtgaacaaaattaaataaagacctacttctttttaaaaacaaaaattaaaaaaaagatgcattaaaaaaacattcaaaatatcctttcacttagaagcaagggaaaacccggccgagcgcagtggctcacgcctgtaattccagcactttgggaggccgaggcgggtggatcacccgaggtcgggagttcaagaccagcctgaccaacatggagtaatttcgtctctactaaaaaatacaataattagccgggcgtggtggtgcatgcctgtaatcccagctactcaggaatctgaggcaggagaatcacttgaacctggcggtggaggttgcagtgagccaagatcacgccgttgcactccagcctgggcaacaagagtgaaactccatctcaaaaaaaaaaaagcagcaagggaaaacgaattcttgtaaataagccttgtgttaaataggaactcatatctgtggcaataggctttttagaatttcataatataacagactttttagaatatcataccactaggaactccacttaccaaacctgagatgcagccaaaactatacatgaagcaaaaccgtatcttttaaataataaaaagtaacttggttttcaatttatgaatcttaaaagaataccgtactaaaccaatcaggatagagaattgataaagattaaaaatgaaattgatgaattagaaaacagaaaaacattggacttaatcccagatcaaaataaccaaataaagtcagtagtcttataacttcattttacagaagaggaagtagactcagacgttaacaatagactcaaacattaacagcctgctcatagttgccctgctggtaagtatcagagtactctaagggcatagatgctaggctctgctgcatttttttcagtgtgaagattggaattatccaactggccaattagtctaaattctgggtaacagtttatagctttaatggctagaaagtggtttgcaagtgatactgctggaggctataattgcttgaggaagccaaggaaatatagtaaaaaccagcagtcatttggggattgctggaggcttggacaataagggtatacaggcatcactacagcctggaacattatgatcaagagccttattaacagaagaaataatgaacgtagacacatgatttcagagaatatttgaagaggaaaatctgaaattgttaattagccttttggcaacacatctccataaatgtatgctgtaatgatcctgtattccattaattcttttagactcccgtatgtgtatcctattcatcatccaattagattccattcccaaattctgcagatttacaatacaacatcctgacaatgtttcgatgcctggtacagtttttaatatgtcggtagatagatggaaggaagtaagtttgtttgatttaacggaaaacagtaagaaattttcgaaaggggagaggggtgctatacataatgacttccttccaaagtagttggtatggaaaagagggcaagagtaactttgcagtggagcaccctgacaaataccacctcggccaggtaaccaagctcgacaccaatagtgataagtcatgttgatagtatgtaccttttgtataagtgatgagaaagtctttttgcctttttggtcttccccaaaacccataaccccagtctaatcatgagaaagttatcagacaaatcccagctgagggacatgctacagaatacctgaccacattcctcaaaagcgccaaagtcatcaaaaataagaaaactctgaggaaatgtcacagccaaaaggagcccaaggaaacatgacaacccaatgtaatgtggtgtcctggatgtgatcctggaacagaaaaagaaaattagctaaaaacgaagaaaactggaataaagtgttgactttaattagtcaaattgtattatgctttgtatttctgttgtgttttagaaatgattaatagacatggtggtggctcagcagaagctgggtggttaaaagatttgtggtgtttaagcctgaagaaagactgggcacatgcaaagtggtgtggcagtggtttccatttcaaaacactttcagggcctcttgatctaacttttggtttctatcatttctttttcctttttattttctaaacctggaggaaccacaaattattacagatgaaatacaaacttttttttctaaccatgaaaagtactgttctccttctctgagatcatacatgtagctgggagggtaggcatctgccaagttcccagacctctacctgtgcttcccatgccagttgcagtgtgtagaggtggcggatactgtggttcaaattttgggggtcatccagaacatcagaagccccaacattttgttctttcacatacagtgttgtaattcatttctcttctgaccttgaagtccatgatgagttttcattgttcttttaaactttcctaagttctcaatgtttccatctacttcaaacattccttcactctaatgttgctactgtggagggtaggcaggagcttgtggatgtatgggtggtgctcatataagacagtccaggatgcccaatgctgtttcctttggtctcttgaccatgtggagattgaaggtctacagcctagaaactggcacttcatggtgcacagagatggattccctcccctgggcctcatgactacctcagtgctgtagcttttcattttgcttccctttagcaattgaggaaactcaaggccatgtgaagggaagtgacttgtctaaacttctacagctgggaagatggcagagactagattggagcccaaagctgagtggaatcaatgcttgcctcctgctttggaggtgacttggggcccaacaccccaggaggcacttgcagtgtccagctaaaggtttcatggcatctgtgttaggatgcccatggaggtactgccaggaattcttcccattgtcctatgaaatcaaagtcctgggacactgcatggaggcattccacaaggtggtgagcgtgcatgtgtgtgtacgtgcctgcacacacgtgtgtgcaggcacgtacacacacatgcacgctcaccaccttgtgaactggttttccgcctctgaatgacatggagataagaaatttcttactttcctctttgaccctagtctgaggagacattaggagggtataggagagcaaattctctgtctaactggcagctactgcttagctccaggcaagggatgccatggagaaatgtggacccagatttgccaattctggtaatttttcaaaataatctagacatccatttttttaaaatgtgaaatctacaaattttaaatcttggcaaaaatgatcttttagtattgttttgtaatcacagtttggactaaaaaacacatatctctaggcatctgggtttgtaacattaaattccctcttttgctttctttcttactggcagtgagtgcaaataattcatttagaaagcataagcacctagattcttcaataaaaacagactgtcttcaatgaagagaaagaaactcacagaaagtatccaaagaaacaatttttaaaaattagataatactactgaatttcaggagaaaaaaaaaattttgtttgactagagctaattaaagttgttttcagtgagatcttaatttcaagaaaactgcttttcatgactttttaagatctatgtaggattacaaaattacgtttgtttgagaagagttacaggggtcaaaaatctatccttagatccttaagaccgcttcataatatgtgaaattgttgctgttgattttttttttagacagacgggtgccatctaatggtggtttaagaaatcttagttaaacatgtgatccttattttttaaaggacctaaaagacaagagttatcttactacttgacagagacactgtcacatactcagatttataacctatatgagcaaactttgacttattttattgcttctaaattggcctcaaaggatttagattagtgagattttcattttgtgctttgcaaatgtgggagagagaaagcacaattgaaacccataatcttctagagctccacagagctctggaattaaagcttctctacactgttcttcctgtttccatggtgggcatatgtagtccaaatataaacagctcgaatggcttttgtgatctgttttttgatgactcatgcaaacgggagtacatgagctcatggaaaatgtcaagcttaaatattctagaaagaagatagaaatcagaagttcagttacatgagttaaaagactttatgtaaccccaacactctgggaggccgaggcaggcggatcatgaggtcaagagattgagaccatcctggccaacatggtgaaacctcgtctctaataaaaatagaaaaattagctgggcgtggtggcacgtgcctgtagtcccagctactcaggaggctgaggcaggagaatcgcttgaacccgggaggtggaggttgcagtgagccaagatcgcgccactgcactccagcctggtgatagagcgagactacgtcttaaaaaaaaaaaaaaaagataaaaaaatagaaaaaactttgtgtattagatcagatatttacttgccctgtttctgttatgtaaaatgttacttttcctggaagtatttgtctgtactgcattattgttcatggaaatggccattgtagaatcagtcttagtatgtaccatggcaatttgtgatatcatggttacttttctggaaaaaattattgtgtgtaggtacattttttgaaagtttacaagcgtaactctcacacaaatataaaatgaacatgtcaagattttattcaacccattagttagtgaggaaactaatagagtgttaatactggtgcaaaaagcatttttggaacaaaatatttacaagaaaattaataaagaaatgataaggtaaggtttctgggtgagatgtaaaactggttaacatcctaccgggaaataaagctgtaacttatggattatatgtttcactgtacaaaaattacttgcacttttcagccaagtaaaaggatgatgaaaaaaaaagaaaaagaaagtacttgcacttttataggacaaatttttcccaatttacatgtgacttcactaagtctgagatcttttatcaatggtaaacaattgttgatttaactaagtgtgttttattgagtggtctgtgccttgtatgatcattaaaagcatagtccacacactactttttggcttgtattcaagcttgggatacctttttcttaaaaaataatcagacgttagcctcatgtctgtgcctatgccattgtcagagtaaaataactgtgtttgtctgaatctgacaaaactaaataaggcaagggaggatgaagagagtctcttgctttctttttctataccatgcttttcctaccttctcattactctaagatggtgggttaatctatttctttacttgttttttcattaaataagcatgtcttgagggtcattgtataccagggactgtactaggtggtggacaggtaaagctattcaagatgggcaagctcaatgtcctgcaggtgtttttgttctaaggagagaaacacaataaatgcaaatagcgacaactacaaagaaggaaacaaaagggcattgtttaaaagaggaatattaggcttccaggtagacattcgtgttgggaatttatttattgtctcagctacacaccataattattgtagaactcatcaataaaatggcagtttccattgactttcactacacctatccattcattctccagggaagggtagacacaattatggtaacttgcactttcctagaccacatgttgtgaaacgtacatcaatcaaaagtggttgccctctacacctagggggcagtagatatcctggtattcccctttatatcatcctgggatttcctttgatgctttgctgtgtttgactcttgattgctgatcctatattttcttctttcttagtttacttggtttattcccttgtttagatggagaactccctccagtaacatcttgagaaagggtatgtagagacaaaagttttaggtcttttatattaggaattatcatgatattatccttccacttaactaatagtttcattgggtatagaattttaactattaccttcagatagttacctttaatatagcactttacagaaaagggttttcaaacaattagagaaacctgcaaggacaaaaggaaggcgagaggaaacagttgcaactcagttttggagccagaaggcaaatggatgagtagtgattctcttagcagatccaagaaagcttagcagtaagctaggaggctgagaaatagccaaatttatacagaatagccactaaaggcacaggaaataatagtatcaggtacctttaaaactttggtggtgagtgagcaactaggtggggagaaaactgctgcaggagatccttaaaatcatcatcccttccatcctgtgctgctgctgaccccctgcttacccctccaaatctggtgttcattctccaggaaaggtaaaacaggatctcttgaatgatgatgtgagccgtgtttgtgggttaggatccctaaataaaacaggggattaagtgaccatatgatgatcgaattcagagactccagttttttacccccttctactaggtcccagatgtcctggtaattatatctgtaccctttaggtgggagaatggaagattcttctttggggaaactgatcaatgtaagagtaaagttttttctgtagatactaaaattgggactttctaataagtggttcactcgttcactgaaagttgacaagccacatccttctgcacatgctcagaactttcaagtattattttggtcacttatccttgatcatatgaagatatgaagatccatatattcagagcatcccagtcatcagtttagtctcataattttaagtatatatagatgatgaagaattaccagatatagaagacagattccagaataaataacaaattatttttgttaatttagaggtaacaaagaatacaaagagggaagattttttttaaaatcagtattttctaagatactttacaaaatcattggattaatggaaaaataacaggatactgttaaattcttagaaattgaaaacgatagcataaatttaaaaatagtaggataattgaaatttgatgatgaattaaattcttgggaagcagagcaaaaatcaaagaatcggtaattaagatataaggaataagatataaggaaatgagaaaactatcctcagaatatcagtgtgaaataataggagttctaggagagagatcagtgaaaatggagtgggggcagaaatcactgtgaaataataaaggaaactttgtccgtttgaaggttatgagtggcacattgaagggaatttacagagtgttcatccaaatggacaagaataaactaattccaagatgcatcattctgaagtttcagaacactttacaatgagaagaaccttccaaagggaggacaacacaaacaatcagaacgggtcacaaacactttagaatcaaaacaattttagattttttagtagcaacactaggagtttgaaaacaatggactgaggctctcaaaattctgaaagaaaattatttttacctacaattctatactcaattaaacctttagttaagtggaaggataatattgtgataatgcctaacatacaagacctaaaacatttatctttacataagctttctcaggctgtgactggagggtgttctccatcaaaacaagggaataaaccaaataaactactaaggaagaagaaaacatgggattaacaaacagaggatgaaacacaggaaaggattcaaagagattccaggatgatagaaacaaggatcccaggatgactgttgcccatcatgtgtagagggcaaccacttttgattgatgtaggtttgataatatgtggtctaggaaagtgcaagttaccataattgtgtcaactattccccaagagtgaattgatgggtgtagtgaaagtcaatggaaactggcattttattgatgagagatacaatgttgatggtatgtatctgagacaataaacatattcccaacaggaaagtctacatggaagtctggtattcctttgttaactaacatcttggaaaggtgtgctgatttctatagtctgtcttctgtaggaatacatatatttctgtatatatgtacacacataaacaatctcttgagagatataaatgaagttgataactgggattgactgtgggtaggagcagcatatggctggtggagggtactgtgagggaggcttattttttactgtttatctttttattccttttaaatattatgccacatgcatatataagttatttaaagatgaataaaataaaatgtatttcttataaattaaaaataaataaaaataaagacaaataacattaactacagtctgagtaagagactattcgttttatttattactttaaaaatgtttagcacttactctatttgtaacattagagtactttgcttttgaaagttgtaaatttaaattctgttttggtttgggagagggcaaagatcattttttttttggtggtgcttgccaaatacaaataagacagattaagaatgcttagaagctgaataattgatgataggaatgatgaagcttctcttgttccacaggagtaattctatagttttagaatgccccttagtagatgtaatagaattcaagtaattctaaacttgaaaaccttgttcctttaggatcatattttcagtattaattacctggtggtcacaccatgggaagatgcttgctatggcattgacaaggtaaaagatgaagctaataaggtcaatgcgttcattcaattctgcactagtaatgtttgtcttttcaggcccttgtcccatcactcatagatactgtacagttgtttattctgaaatgtaaagagatagagtcaactttcaaattgagggaaggttttatttttaatcgaagtcgattaatgcaaaattaattgaattatgactttctttcattgtcttctattgggtcctaattctcatttattttactctcttccttattctactccgtttctatatagttattgagacatagaaaaaaagactctttgactctttccttttaatcagaatatgctatacctattacatttcctaaggtgcccatcatttatttgagtcaagatgggaggaaggtactgtcctagataaacaggatttagaatttattgcttataatgacacgttgttgatgaattttataatatttgatgctcttatgggctacgtaatccaggtaaaaaataaagtagggaaaataggagtaggtttttaaacaggaacaataaagcatcgtgggaaacagcaataggaataaattaatgtcagactaatgtaaagaagcaagatattggggttccttggtgacaatcagaaggggcttagctttttcaggacactgagtcaatatggtacactcttgtcctgctgtgttctattctgaagacatccttagtttgtctaagtgtcttattagtcattaccagttttgaggtggaggggaaaatattagactgtgagtacagatggtggtaataattgcatgggaacagaagatagctagcgtggtgtcctttcatgaatccttagagaagaataatactgttgaatgttagagtgggacagaggggactttccactttgtttatcctaatatgagtttgcagtatcacaaactggagattggcggataaatattgatgttgaaagtgacggaaaacccaacccaagccagctagagcacaaaacgtaatttattgtctcagaaactgaaaactctaggataaagctggattcaagagcttaagcttgattatcaaaatgtggctcctttcatccccttggctctgtggctgtgtttgtttcatttccagactgtgggagaacttgccccaattatcacaatcccaaatacagtggtagagggaatttccattcttatgcttaaaggaaagtctcctaattgtgtcttctgtcttcttggctttgattgacctgatctgaatggccaaccctatgactctgtttaagccaaggaacatattttaagtatctttgtgttctcggtgattgatgagcacagggcgttgcatgatgtacaggtacacaatatacaaatgttatgttaaactgtaagctgcttttctgaaaacaaccattttacattgtaagagctggtctaatatagtccagattttaattctgaaatttttttggagcaaaattaggtgacttgttggagagactgaatatgattactagaattcaagaatttgagactttctgcctgtgtgctatcaggactctgtcagaacctcacagtagaattcaggaaataagcaagaaattaaattacatatcatcttagcatgctaagagatctattaagagataagggatatagtggaagaaagagttttaatttcttttgaatcatacaaaacaaaagtgagaggtgggagaagaacatggatgatagctggaaatgagaggatttgaatattggaatatcatcccattagagaagaggaatgatgtcagtgatgctaaaattattctttcacagttgcaacagaatacaaattacgcacatcatgatcttaaaacatatgtttgaaattcattttatagagaagtttaaaaataagtggtctgatggggcatgaaaaaattttgttaaatctagtaagagaaaaaaatgacctaaaatagatttaagacttatgtgctgtgtcaattactaatgccttgtcttctgagtttaatttaaaaaaagggaattccaaagactagatttttagtgtgatagaggaaagtgtacctagctactctaaaaaataaactattcagcatttgtgtaattatgcctgtcttctaatgggaacttcattttcaaagctttttttaatctttaaattctattgaatgccaactttgcccgaacaacttttcatacagtgtgaaaagatgaaagcaaaggagatgcaattatcaatgatgtcacagaatttgaggcatttccaatcatgcctgtgtgctcattttgcataatcaaaactcactgatggggaccaatttaaaatgaatttactgacttaaacacaggatcttggagctctaattgcctgggaaactgtaagaatgcagcatttgagctcattggtcctgacataaaaagatgctgttaaatatttaaagtagtcaagagagctgtagtgtcatttaaataaatgtaatgtttattagagtaataaagtgaaacttttaggagattcataattatgcaatcttatgagagttttggttattgtgcatgagcttgaaatatctgaatgcttggaaacgtagcataaatgatctatcatattattcaaggtggtgatgtgtgatttgttgaaataaaatgtaaatggcagtacagtgtggttattgggtagagagtttggagttagcctccaaagcctacatagccacttaactgaataatattgcatatgttgactaacccatctctgctttagttttctcagctataaaatggtactaatgctatgctcgccttcttcatagagatattgtaaggattaaatgtgttaatgtatataaagtaccttaaaacagtgcttatataagcatttgctgttatgatcactctgtaaaagtcattacggtttttcttccgaatgcacaaaatcttaaaatgcaatatcagaatatgaaaaaacatatgaggaagttcgcacatatagcattgaaaagttcagtagttaactcataactacaaatttggccttttgtatgttcactccaagacacacttctaacacgattcctcacactctaggacagtaattctcaaagtgaattataccaaggatgagttggatcagaattaatagggctacttgttaaatgcatattcctggtcctcactttagactcactgaatcagaatttttgagagtgagaattagcattttaacaaatgcctgaggtgatcctaatgcaggacagattttgagaactgttcttacttgttcatgattccctctactcatgctgtaatttcactttcactctgtctcacattgcacttcagatgtcttatttctctcagttcatggttctgtcacgtctcctgttcaaggactatagatttttctttcaaaatcacagtagattgtagttgatctttttctttcacattcaaagcctagtttactaccttctccctcttccattttgtgctctcttcattgtaccttgttcatttccttgccactatttgtcctaagtgggatgtgaaatcattctggctttagaattccataaaagaccttcacctggctttggtttagctcagaactgctccccctttcctgtctcacacatgctttgctttttcccttccatttctctcatctttttcatttcctttctttccatgaacattcctgggttggaagacagggaagagtttgcagctggtcaaggaaaactcttcttcagatttcattggtcttctggcaggtttgcctggagagaagggacaggtacaaaggaagtcccaatccttcagcatctctgtccctgttagcttatatccctttcctggactccatttgaactcggcatccctgtctggattttagagtcagaagtgtgtgagacatcattgagcagtctcagactgcattgtctgtatatacttaacggagaacattgcacttaaatcctaaaatatatcaggaactcatatatttggcgtgtctaagtataaagccatgtgtagccaagtggaaacaccacatacaagaaaattgtattacttcttggccaaggtaaagattaataggaagcattttggctcatagagtatgtaatgcagctctcctttaaaacacgtgaactttttatgttcgtgtgaatgatcacatagatccacgggaatcttaatgatccgtgagggaaattgttcacatttttagaggtatatctacattacaaaacagcagcactttcaggagaccactgcactgttgtgctttggaaagcacttgaatcccagagtgctgaaagtaggaacagtattgatgactcataaacacacatatcatagtgaaaaaaaaaaaaaaaaagaaagttgtcatggaaaaaaaggaaatatatactttggcaaatttaaagcaacatggacattttcttagacgtggtcttagtattttagctagtaaaatgaaagaaatttaagtcctggaaatttatcccttctttgaaaggattagaatttctttgcaataactaagaatttaaaaaattctcaaagaagacaagtttaaggaaaaagtagacaccaaccaagaaatcaatttattgctaaaaatttggcttcaactgtttcagttttggctggtatttcgtagttttatttgtgtaaatatgggctttaattaaatttccatgttgctgcttaggtttttcttaaaatgtggatgtcaataaattttttacatgaactaaatttaataagtaagtttaacttacagctattatcttggtatagaagctaaaaagcaaaaagtacttctgaatagtagaaagagaaccgtaagaatagaatcgtgtttttttaacttctgtcgtcacatatttgagtttgatggcttaatagtagatgtatttatgtcttagttgtttgctgtctaactcttcatactatgtttatatctatagacaatacaatctaatgagaatagattagatatattttgtgaataatatttttttctttttgttttagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcggtaagaaattattatagctctatttttactgaaatagatatgacgtttcttagttttaatggcaaggattttttttttctgtttgagattttgagcagtttcattatgataaatgatggataatttgcagataatgctattccatttttatctcttacaggtttatagagtgctccaacataatcatgtatatttaacagtactatttttaaagatatagactgatcattttgtagtgttcatatatttattttagaacaagaacttttcattttgggtaatttggattgtagctatctctgctcagatatactatctattgtaaggtggtgtagagaaaacgtatggaatatttaaaagtagagaaacgacaatagtaaaaaaaaactttagttatgtccaagagctcttttagtgggaaaaattaagtatattaacttaagtaaatgttgggtagaatttgttaaactattgatctatctagcacacaatttagttactgggtggattgtgtgtgcataagtatgtgtctatttttaaccagaaagttatgtcatgtgaccactaagagtattgctatatttgagtctcaaagtacttatactttttgtttgcaaaaataaaatcttaagaaataggcttaattatcacattgtgaaatattataaaaagagaagatgaagaaaaatgacctatgaacgaatccagtgctataattttagttatttgtgacatatatctatatatagaaattatttttagagtacacattatatgagataatctttttcataaaattttgattgaatcctaacaattttttcaggttcctttatcattttcacaacttttcttaatggtgttgtaattacttcctgatcattcttccttttcattgtggttgcttctaatttttacagttacgaatgttattctggtgaaactgtttacatatattttgatttttacctatttcgaattgttaaacgattttcataggctgaattactgtgcttttctgtttgtttcagtggctcttgataactctttcttaaagcttgtgtcattttctatagtaaggtatattttccaacacccttcacaacttacttggatttctcaagtatttaaaacttaatttattgttatgtatgagaactagaaattgactaaaatttccctatacatgatttttattggtactaaatcaaatattttttctagtagcttaattactcattttgagctctttcgtgaaagagatctcattttgatcgcacaagctcatgcagaatcttactaataatactgagaatcttaccagtaatgctgatttcacagaataagatcctaaaaagttaaggaaaagtttatgatgactaaaacatttgaaatgctaaaataattagatctttattggagatgtgggagaatataagtacaactttaggttgagtttgggaaagagcagtttctttgaaactgatagggaaataattgattttcctgacacagtttttggcaggccacatacatctctttcttttccttttctcttttttgttgatatataatagttgtacgtattttgggggtatatgtgatattttaatatttgtatacaatgtgtaatgatcaaattaggggaattggggaatatccccaatgatccccaatgatcaaattaggggaatatccctcacttcaaacattaatcttttctttgtgttggaagcattataattcctctcttctagctattttgatatatacaataaattaatgttaactataatttccctactgtactatcgaatactggaacccattccttctgtttttgtactccttaaccaacttatcttcattaacctcttcccttctcagcctctggtaaccaccattctactctctacctccatcaggtccacattctttagctggatgagaacatgtggatgagaacatgagatatctatctttcagcacctggcttatttcacttaacataatgacttcctgttacatccatgtttctacaaataaaaggatttcattctttttgatggctgaataatattctgttgtgtagctgtgcatatatacaacatttttttgagaattttagctataatttgtcttattgttaggtttgctgttgtctactccagatcaatcaagagcagagaaaaaaattcacataattgctttcctatataattctttttctatgtaatatttgttttcgtttcacagcatgaacaaatgattttgtttagaatcatttcttttttccttttttttttttgaggcagagtcttgcactgtcattcaggctggagtgtagtggtgcgatcttggctcactgcaacctccgcctcccgggttcaagcaattctcctgcctcagcctcccaagtagctgggactacagacacacaccaccacgcccagctaatttttgtatttttattagagatgaggtttcaccatattggccaggctggtcttgaactcctgacctcgtgatccgcccgtgtcggcctcccaaagtgctgggattacagtagtgagccactgcgcctggcctggaatcatttgtttatttctgaagataagttttttcagttgttaaatatttatgatttttgtttttgtacaccctatctataaacataaatgtcacttgatttatgctttttctcttgattgctgtaattaacatcagttttacttgtcctaatactgtgttaaataagaatgatctatattttgcatttgatagctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacaggtaagtccgtgtttcctccttataaaaattataaggaggacttataaaacttataaaaatcttttagtgcttaacaatctatctatctagagatgagccaattcagataactggtggtggtattcatagaatccagaactgacaacctcttcagcgcttccacaatctggttattccttgatcttgttcagaaactctgcaggtagtttttggatccattcagcttactcgggaattgccatgacagttgctccagaaaactttgccttccctttggcctttttttcttttattcctcccctgctaccaaatgtacaaagaatgactgtgacttctgagatcaaaggacaagaatacaaaaagcgggcatggaagtgggaggtccctgtgacttaaattcagagtaccgctgggagaaaaacctgaatagccttaggtttaattgaactttatggcttggtttattaggttgaggcaatgactcgctaacaccattctggttgttttttctaaagaacattaagaatttttttttgaataattgtgtcactaccattaaaatgtttgtgaaaattacacttgaaacagttatgttttgctcttttaaatcattctttaaaaaatatacttttgtgctgctgttgaatatcagtacaaatgttacagaaaactctccattttataaacagttttaatgttttatcttcagtttggttctgtgattcatagaataactaattctaaagttccagtaccttcaatagcataggaaaaattacattgaatagaattttgtactgtgtacttaattctgttatattagtgataacatagtaattataactaatttataatatagtattattagccagtgattatttataattatactatcatatattattaagagtcagtgactaatggttttcaaaacttttttgaaaatttttcatttggaacttcttaaccatattgatgtaattagaatgtttacttaatctgtgcattaagattacatatgtatttttattatattctgaataactacttgaagacaaattctacaaaaataaatttttaacttattattttatttttaattcattattttatttttgggattttattttagaaaccttcagcaaatgtgaagcttggatggccaaggactgttactgtgacaatattatcaaatgacaatgcatttggaattatttcatttaatatggtatggacacaatttgatgataattgtggttgctagataatagtttattaaattttaaaaattagttttcatgatgttagctagtatcatgctgtgttttgatatttaaataaaatttgctttaactttgtccctgtttcacattctgtagaccattcatttgttctacctaagatgtttgtgaattgaggacgcttgtatgatcgtggtcatcttttgtcctaatctctttctgctgattgttccacctgactcctttgttaactcttctgtctttaactcagatataccacccattgccttttcctgatttccccaaatgtcacctaaagaaagtgttgtttgtttgtcagactcttctgaaagtttggagttaatgggagatgagaaagcatattgaaagaatacttttctttttttttaattattattattatactttaagttttagggtacatgtgcacaacgtgcaggtttgttacatatgtatacatatgccatgctggtgtgctgcacccattaactcgtcatttagcattaggtatatctcctaatgctatccctcccccctccccctaccccacaacagacgccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccatggtgtattgtgccacattttcttaatccagtctatcattgttggacatttgggttggttccaagtctttgctattgtgaatagtgccgcaataaaaatacgtgtgcatgtgtctttatagcagcatgatttataatcctttgggtatatacccagtaatgggatggctgggtcaaatgatatttctagttctagatctctgaggaatcgccacactgacttccacaatggttgaactagtttacagtcccaccaacagtgtaaaagtgttcctatttctccacatcctctccagcacctgttgtttcttgactttttaatgattgccattctaactggtgtgagatggtgtctcattgtggttttgatttgcatttctctgatggccagtgatgatgagcatttcttcatgtgttttttggctgcataaatgtctccttttgagaagtgtctgttcatatcctttgcccactttttgatggagtattttttttcttgtaaatttgtttgagttcattgtagattctggatattagccctttgtcagatgagtagattgcaaaacttttctcccattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacaggtaagtctttaatctatcttgaattaatttttgtataaggtgtaaggaagggatccagtttcagctttccatatatggctagccagttactttcaaaaaacttactatgaacttaaattgaatagcaggtattacatctcttcaaaattctgtagtcatcccaactcttaggttttcccattaattaatattttctgaagattgaaacttcctttcatttcactcacctttgctcaatagtgtattttctgttccttaactgaattcctgtggctctggccaatcctgtgatcagagagttttatctttagaaacaaatacacaaaatagggcccttcttgagataaattgtttccagctcctaaaaccaagtttatctccaatacaactgaatctggtcgctaaattttagactccagtaacattcctgactcggagtctccttgaatcacattactaattataattaataaaacacgttgcaatacttcccagcttttcatttatttttagattgctactacaattggttgtattgtatgtcattttcttggtaccttaacttatctttgaaagaagtgggctataagtaaatatgatctttatagtgcagtatctttgttaaaaagggtatttggccaacctcagtttagtagaaattcggtaacctccattatactgtcatttacagacattaagttaattaatcaaccatctcttttatttgaatgataaggaattgaatgataaagaattgttaatgatgaagcaggctcccttaattgctaaatttctctccatgtggctttcctgctacacttactctctgtgtatcacctccgacctcatactgatttgtttaaaggtttcttttgttgttgttgacattatatatcttagcctatgggaatgaatcctagtttctgtcatgggtcctaggtccctgactggtgggggtctcagtgctgccaggcagcctctgacatccttaaaattaaactaaataaccattgagctcacggtggtgctcaataggctggctttgcttttcagccctgaggatgattatgttggtagtgaagatgacattgatgatgatgataataatagcaacatttactgtgccctcagtatatgtcaggtactaggataagcacttgatgtgaactatcgcattgaaacctcatcacaacccttcaagacggacattgctaaccccagttatgtatggggctactgagttttgctgtcaccctgagagctggcagctgcttctgtagcctgtatgtacttggctgtgtccgtgttcctcctcttctaccctgagtttccaccagctgaaccagcatatttcttttgaagtctttgctttcacctcctgcagagatcctgtcctgaaagttattagcagtgtctgcttttcactgacaagctggctgatgtggagaaagagtggttgtggacaaggccaagtggtggtcccagtgacctgctgccttggtctggaggcttaattcatgtttgtgacctcctgggcccctgtgagcatttgagtttgtcacctttcaactaaaaaacctttaaattcctcagcagaacagctagttgatggtagaaccaggacaagaaaccacatcttttgcctgactagtttttatgttccctttacactattctttttaactttttcagcattttaaagctatagttcattgatgctaggaaatatcacattcttatcgtacagtgtggattgatgtgtctgtggaaattgagcgtttctgaggtaatagtttttaccgcctcatacctctgattgctcagctcctgatcatctgtgcttgctttcctcaatagcttccctcaatcgcagtgagtgagcccaagggcagaaatgagtctatgcctcttactctcatcagggaaaagggaacctatggaatggtcatggtgacttttgaggtaagtttactctgaagtcattttattttatttatttttatttttatttatttatttttgagacagtcttgctctgttgcccaagctggagtgcagtggtgcgatctcagctcaatgcaacctctgcctcccaggttcaagtgattctcctgcctcagagtcccgagtagctaggattgcaggcatgtgccaccatgcctggctaatttttgtatttttagtagagacagggtgtcaccatgttggccaggctggtcttgaactcctggcctcaggtgatccgcccgccttggcgtcccaaagtgctggggttacaggcgtgagccactgcacccggccctgaaatcactttaaatgcgaacactggggttcataccagatggctgcaattttgaaaatcaaagttccttgtataataaacatgacacaatacaattaaaataaagatgaatacttttctgatctgatacatttcatgattaatataaaaatgttttccttgctgcttgtgtatacaatgcttacatgaaatacaagtaacattttagatatgtgggaaaaataaatcataggatagaataataatgttaattctataaaattcatggaacttttatgataaatgttttcaaagacaggaaattttaaaatacccatggattacttaggtttacataaaattatttaatatgttgtctttctctattttattttattttattttttttgagacaggatcttactctgatgcccaggctggagtacagtggcactatcatggctcactgcagcctcaacctcctgggctcatgcagtcctcctgtatcagcattctgaatagctgggagtacaggtgtgcatcaccatgcccagctaagttttaatgttttttgtagagatgaagtcgcattatgttgcccaggctggttttgaactcctgagcacaaatgatcctccctcttcagcctcccaaagagctgggattacagtcatgacccaccatgccttccccctgccccccatttttttcagtacaccaaatggatggtgtttgtagccattgcactccaccatgggaatccataaatgttacaggatgtggcatgaatatgataagctgtaggtgaggtgtatttttcaggggctagctctaatcattttatttgattgcttactgaccatgtgccaatcattgtgtcaccacattgctgttctatgagatacacatttaaatcttcaactaatttttgtgttttttaggatccacaacatgattatatactattttcaaacattagagtattagcaatttcagataccagtttctttcctaattattaattgtaatatcaataaaatggaagcatatttatttaacacaattctatggtagcatagaagagttctgttcatgcttgtgggtgtccacatcatatggtagttatgttaactacacagaacatagaatagcagaagacaataatgcatgaaaaacacagtaaacactaactaaatatgcagtagtcttgcaagttttacactggaagcattacacagtttttcaggtacttaggaatatgcatttagacaataaatttttgaaaatttttctgataaatattggaaaaattagaaaataattggctgtagaaaggataaatcatccagagtagagtgttttcaacttatctatggatgtctaaagttattttatcaggtttgtagcctgttttttgtttaaataattataagtaacatttttggagtgcttaatattgccatatactgttgtaagtgctttatattgattattactgcatacgtatagcacccctccctggcacttgatctctctcatgctattcttaattttttctctatgatacttattatcatctaacgcatacccattcatttatttatcatttattcccttcctttaaatgtcaggactatatggaggggaatttgctgtgttcactgctaaatctttagtacctaaaagagatgcagcatagagtactcaacaaatgcttttttaaatgaatgattttatttattcttcacatcttcacatccagcttgtgaagtggaaaatactggtattacttgagggaatttactaatcttgaataccctttcttccaagaagaaatatttgtagagttttttttttcccctcaggtttaacataatggttgagaaaaaacagctcgtagaaaccacgtagtttaatgcagttatagtcaatatctataattacgttataggacctattaatttgaagggcagaatgatgtatgggttagtgtaattcttgcagaacatctttaaacttcagatttttgtcagctgacatcacaatgatgctttctcagtcttgtgaagtattttgcatttattgatggcattttgtgtttctttgcaggtagagggtggcccaaatccccctgatgaagatttgagtccagttaaaggaaatatcacctttccccctggcagagcaacagtaatttataacttgacagtactcgatgacgaggttggctaatgttacatacccaaatgggacaaggattctgtgttgcaggacacagtcctgtataaacttagtgtattgtggccagtcgcacctcagctataaatagctgactgttctggaatacatcttattactatttatcttacttaattcacattaaattacacatctaaaagctgatgaatctgaatataactggcaaccatacatcatacaaatatttaagcattttgtataccctggtaatcaatttttgttagtgctttcaattttgagcaagaacaatactaacctagaataaatattttaccataaaagcaaagaaaaattctactgcagttggtattcttttgtttttatttttttgttgttgtttagaaggagtctcgctctgttgcccaggctggagtgcagtggcgcgatctcggctcactgcaagctccgcctccagggttcacgccattctcctgcctcagcctcccgagtagctgggactacaggtgcctgccaccatgcccggctaattttttgtatttttaatagagacggggtttcaccgtgttagccaggatggtctcgatctcctgacctcgtgatccaccagcctcggcctcccaaagtgctgggattacaggcatgagccaccgcacccggcttgtttggatatttttaatgttcacatttatgggaagatttttattatttttatatttcacattggaactagcaaggatagagatacatgatacacctagcttaattgctaagaatgaatctgaacaataatgtgcaaggatgtcccccacatgagctaaacgagagaaaacatgactttttataaaagaaactaagttttgccagaaaagaaaacaaaaagaaaatagctggcaatttgtaaccctccctctaccctcctacaaaaattctgaaactaaatcacaagaaaactcaagagaagggaaaaaatgtattagagtattagaagacattattagaaaagaatttttctcttgaaaaaaaatgaaatatttggaagcattgatatctccagttcctctggttctggaagcaagcaaaaaaacctttttgttttaagatctcagagcattgaacgggctataatttggggagatgattaattatacattttgattgtaaatttgaaagatcaatcgaatcataacattttatttttaagataaatagctttgctttttatattgctgctgatggaggtaaaagcatgcatttttttcacttttatttctaaaatagagtttatggtgaatgaaaagctcacacagcacagtggagattaaccccaagatttctctgcagcagcataaataaaaggaaaaaaaaaagaaagaaaaaaatgaaaagcaaaaattgcactttaacagtgtcagcatttttcctagtagtgactcttacagctttttctccagagaggcatgatgtgtatcttgaaaagcatatattggtgtcacgtgtttaactcctgaattaacaaccatttggagaaaagcaagaataattcacaaggaaaactaacaatttttatgtaatgtttaacgtactttccagattcttaggtattattagactttcagtactacttctaagcatatcaaactgataaaactgatagaaatgtatgacagttttttactgtttaatctttggagttatctaaggaccagttaaggctgaaagacattatacctggacttcattacttgtactattgcttccttacgttttcttttcctgtgtaaaatacattatttacctgtggaaaatattttattaattggagactaaacaagcctttctatttgctccctcagttaaagaatttttatttctatgtaattgtattgaaacataatgacttgttacactttagtttatttgcaggtgttttggctgttgatgttttgcctctgtttatattcctttaacaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaaggtatgatttattttaaatatattgctaccattattttattatattattccagatttaagttttgtggtgttggacacaacaatgaactgttagaatatgtgtcattttttcccacaaagtttcatgacaaactcagaaaagacacacacacacacacacacacacacacacacacacacacacacaagaatatgtcattttttctaccatggcttcactgttttctttcttatttggagtgtgatttaattatgcaaatgattcatagtatagtagttccctaggacacattcacatatctacaccttcatattaaaaatacttttttccgccaggcatggtgactcacacctgtaatcccagcactttggcaggcttgggggaggattttctgagtctaggtgttcaagaccagcctgggcaacaaagtgagaccccgcccacaaaataaaataaaataaaataaaataaaataaaataaaaagattagctgagtgtggtggtgtccacctgaagtcccagatacttgggaggctaatgcaggaggattgcctgagtccatgaagttgaagttgtagtgagctctgatcacaccactgcacttcagcttgggcaacagagtgtgacccagtctcaaacaaacaaaaataacaaatcagttatttttttgttgtatagattctgtttttatcagtgtctaatggacaacttgacattgggaaagcttatctaagggaaataaagtgtactatgtgacaatatgtatttcttttaaaacatttaagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggaggtataacccttgttatgctttatgcttgttaatatttctgtgctgtacaagaaccaaagaatttggtcatacacatcaactttatgtttagtttgaagggacaggaaaaacactggctttgcaaatgatagttttcttactcagtattccttctgaaaataaatattttaccctctaaaaaattccacaaactgtgatttaggaatatttccaaatctgtttttggttcatcttttgctctattatgtataagaagtcatcatttttagacataaaatattaataaatattaaaattagaataacatggaaaatacagagtttgatcatctcagatgcgagaattctgtactttaatattttattcctttacttcagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacaggtacttgtatgattaaaataatcgtaattttggttaaccttcaagtgtactaacctgtgtgaaagaattaactgaacattattttgaccttgttattttgccgtcatttatatgttgttactaaaagttgtttaggtagtcggaagagagattatgcctgctcctaaggtatataagtataaataagacaagaatttttaccaaagttaatattttaattaagtgacattaaaagtacaccagacgtgaaatgccagtcatgcaagtcagactgtcatggatgacatagtagagtaacttacaaactattacaggggagggcgagagaaagagaggctaaccatgctttgaattgatttgggaaaatatgacataggaataggatttgtaggataagtatgttttcataatgaatattgcaaggaaaatatttcagaaacaaagcaatatgagatatatattttttctttttttttgagacagggtctcactctgtcacccaggctggagtgcagtggcggcatctcagttcactgcagcctccacgtcccaggttcaagtgattctcctgcctcagcctcccgagtagctgggattatagatgcctgtcaccacacctggctaatttttgtgtttttagtagagacggggttttcccatttttggccaggctggtcttaaactcctgacctcagatgatccatgcgcctgagcctcctaaagtgctgtgattacaggtgtaagccaccacgcctggcccaagaaaaattttataaatacttttaaataatatactcaaaaatcaatttctttgtctaggtagactctctggaccttcaactgtttagtaaagtccccatgacgtatccttccattttatacatttcatttcttctgttaaccaaaatattatttttatggccaaagtataaaatatctgcactcatttatgatactgttgttgttttccatgtgttgattgcttgatacttaaaattctaaatcaataaagggtacttattaaattatgtaaatcaattaaatacagaatcaggtagtgtgaatggactgacaaggaaagagctaaaatcttatgttgccatacattgtgccaactgaagtatatagcaaatgaaatattctatttcactaatttctttgaatcatgccacatttaaatatgtttcatattttgccttgattttgttttatgatggatttattattcctttctctggagtttctgattgtcccttttctgtatgttatcttcactatattattgagatcttgctgctgtcttcctgtgtgtgttgaatgttgagtttagctaaactaactgctttctgtgcttgtttcacatctgttgtctgggatttttttactgagctcctgaattttcttgatctgttgcgtttctcttttgggattatgctgtagttttgttgtagtatatctaccctcaaacaaatgtgctgaaagtatatatgtaaggtaaactttttgagtctttgagcacctgaaatgtgaaattttatactcatattgatagtttggcttggtagaaatttctggattaaaataatttattcttcagaacttgaaaggtattgttgttaagcttctagagttgcagatgagaaatttgaagggaaggaaatgatttatcttttagataactcgatctttgtctctgaaagctttttacaactgttccttggtgttctgaattttgtaagactgtgtcagcacttggtagggtgaccgttttcattttgaagactcccgcgtttttttaagctgagcctccaggcatacttgtgctgttagggcatttttcgaggactcttgtccaaggggcttagtgggtgacctgttacggggatgtaggatttgtcagtatgtacgcgacacctttttgtaatatacctacacagagggaggcatttgccatcttccccagagccctacactaatggcagtagatcctgatcttcatctttattattattaatttttgttttcttgcgtctcctccaagcgggaaaattttcatgtgatgcgagcttctgcctgtgaggataacttactctctggaggacccttggatttttcttggagtggaaagatagggaacacggctctattcacaattgtgtctggtttgtcctgtggcttgtggatgccagggagtctggatctgtgaagtgaaatactgcaaatggccacgcacatgacttgggcccttgtgagcattaagttaaaacaactagaatgctgctaccagaacacatttagagctatatttagaaactaaaaacaaaaacaaacaaaaaaatctctgactttatacaaaaacatgacataatttgtttgcttttaaaaattgattttattaatatggaagtgcatattgattttaccagttcacacttagagtagcatttctgaagtttcaagactgtgtgggattcaattttttgagtttcagaatttaatggaatttttttgacattagcacttgtttgtcttctctgctgtcagtgtcctcaggtttcagggtttcagaacattcccataagtatatgtttaagggctttttttgggatttttttggtcttactgttctcccttctgtttgtctccagtcttgcataatctacaactcatgcaagaaccagattattaaaacaagtggaatgagacagagatttttacacagttgcttttgctttcatggaagcctgggcattctggcatatgtggagtagttgcagtgatgtgatagaagtttgagaattgatgatgcagaaatgttgttttggagttacagagaacgtttttgttatcatttgagctttctaatgtcttttctcataatgcctcaaaactagtttttactgtggataaggacagtaaaaactgtgctaatatataaaaaaatctgtaccaatatcagtatcctctatgttaaacttttaatcttttgaaaaagtccaatatttctatccaagtaactgcagagaattcttgtataaatacatccttattaggaactttgtacaagtcagatattatcttagctactctgcttcagcattctatataaacatgacaattaatttttgatgacacttgaaagctaagaaaaaagttgaagaaggatgtaattaatatctgatttttggtgatcctgggttagaaagttgcaccactaatttcagactcaattctttatgtatctatatagttaaaaccaaaggtcttacagtgcagttaatttatcacttgcttagggtgaacaaggcattattagtcactgacacaagtcattgaggttcaaaacagctgtaggttctggaaggctagttggaataagagggctgtgtagtttgcatagtacataatggatgagcaactcaagaataggaagcctcagcctctgcatgcaaagttgaatgaaactaaagaaagcagaattctttagtcgctcctcattctttagtaaccctctcagctaaatacgttagtctgagatgcagcttttggcaagcatggggttactaatgtgctgtcccagtggcaaactatctgaaataaagaatgattctttatgaatgaatagagcagtttgatttagcagatggaacccagacagacaaaaaaaggcttataggctaggaaataagccctgtacaattaacattttcttttccatcagttcatttcataaccatctacattttctttctatttgtcaaaaatcctatatctaggattaattctataacttttttgataagtgtagggaaatatgacttatatatttctttctttttagaaagttttgtgtaaaaattattgtttttttcttgatgcttaacacagtattatcagtttagctctttttgaatatacagcaatgacaatgttcattcacgaatgtgtgcttggtcatacatgaccagtgtattttagaaatatctttgccttataacaatgcacacccttatatttatataccattcaaatatacatattttatttaactttgtgctattttgtaagataaataaatatatatgtgtatatatatatattccttttctctagaaagaatgacagttatgtgactttaattatttatctttacattttatctacattgtaaggtaaatgcagtatactaaagatcacgttttattttatgtggcttcatctatatgccaatacttgacaaaattgatcaatctaatttttttcttttttcaaatgaatatttaccaaaaccaaaattattcatgtctttctcctgtatatgattttttaaagcaaaatgtgtgacatttaaaaaagacatttacttttactattaaaatgtactatccatcgcaaaataggagagaaatcagtaccagtcctgtccacgtgtggaaaatcaatttaaatcacaggtctactggtgattacttagtgtcatcatttcaatattataaagcctaacagagggctttaaagagtggcagagacatgttttattaagttaaaagttgcattttattttaatatttaaaattcctatggtttttgcagtcctgtgacgattacctattcctgcattcctgaagtgaacactgtgtgcattgattgagaagttaggttttgaaaagttagaatatttaagacgttgaatgtttgtgatttatcagaattcttatagagctcagattgtgtagaagggaggaattaacaaatatttattgtgaagctgctgcagtttcaagtctatgtcaagcctacgtcatgtattgggaaaatgctgaaaaggacacagacccacaagagctctgcagacctgttgggaagtaaaaatctggaatgaatcaaatgatgagaaaccagcaatatgtaaaatgtataactgcagggacactatatgttatacattgcagttctttaaatgtaaagatgcatgaagttataaatggagttctgagtagtcttctgatactggattttgtctggaggagaagggaaatgggggatgattggaagtgtgggtcagtggaagacaggaaggagatgtggatgactctctgatatttggctttaaggtcaaggtagttggatgtaggtggcaaggaggaaaagcaggtggtggcactgctgatgatactagtgaaggggcatggaacagggacagtgatttctgttttggatattgtatatgtaaggtgtttgtgtgacatttatatgatgtctgtggcagttagttataatgatttggaattagagggagagatgcagagattattaaggagcaggcataaaattataagataaagggtttaggcagacccttggggaataataacaattgaggggcagaaagagctccagaggccagggaaggagattgaaaagggatggtgaatgagagaggaggagaataacattgcgaagttattggtgacctctacctacgcttactttgtcaccccatgctgttaagcttttttaaaaaatttatattctatcaattcttactactttttgtgtatttgtttattatagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtaagtaggctctttcttactgatgggggctaatgagtatgaagtaatgtacagacactatttttaaaataagatcagcatatagggttaacatcttaaaaagcttcagcatgtacaagaagccttcagtatgtcatttgaaataggtaactgatgagtatgtgatttttccatcatcgtttacagtattagatagaatgaaattggaattaattgctcacagtgagtgtcggatattttgatgtgacagctttcagatagttctatgacattcgatactacagtggtagccaaacataaacttttttttttttttctttgagagaggattttactctgtcgcccaggctggagtgcagtggcgtgatctcagctcagtgcaacctctgccccgggctcaatagatcctcccacctcagccttatgagtagctgggactacaggtctgtgccaccactcctgcctattttttctttgtatttttagtaaagatggggttttgtcatgttgtccagtttggtccccaactactgagctcaagtagtccacctcccttggccttccaaagtaatgggattacaggcatgaggcattgtgcctggcctataaacctttttttttttttttcttaatggccaagacatggtaccacaggtgtgcttgacctacttcatttctgagcattccatatgcttgggttggagtgaggtggccaggttgggccttatgcttgatgatggagatgatagtggtaaagttgtggaatgctaaatcttaagaattttttactttatatatacaatatatgtaaatttttgcatatagacatacaaaacgttcacatgcacagcaccccatccctccccttgcccccaccccgacatgccctggttgaatttttctcttagggatggctcttccttcagccttaccatttcctgagtcatagttgatccctgagaccttctccaagtcccccacacttaaatttgatttaaacctagttgaggtttggatcagaaagaaggagagctgtttttgttatcaaagccttatgttaaaatatggtgacctcaatttccattgtatattagcttctataaatggacagagaagtttcatttttcaagatggttttgatttttcatatttttctgaatacactcttttcttcttaaaacggaaaagcatttagtttgctcttaaagagttgattgcttttatcttagatagctgtaaatttaccgtttcatatttttcccttaagaaaaattagcttttaggaagttttgggctccttggacctgcattcttccctgttgggaaacagcagaaaaactaggagttttcctttgtttgttccagatacagcctggatgatgcccactccctcaaggtgattcagggccccagccctctgttataagaatctttgctcactagtctcaggttatgacgattgttagctgaagtagcagaatgattaatggagaaaatgtcttgtttttttttttccaagatgagcttaaagggcaaagaaaaaataaaacaggatactcctcttttaggagcataaaaagaatagtgtaatctagcattaaatattcctttatattcctcctttgaaaaaaacttcatcatgatatgcagcgatccttttattatacattttttaaagtgtactgcccttgaatgaaacctccaaatacaatttgtttcagaattattataatagcttccatttatttagcttatactgtggagaggcactgtcctagatactttacttaaacaattcctaatcctcaccacaaacttgccaaatagggaatcattagctttatttcacatgagaaaattaggatcagagaggttaagtaacttgctcaaggtaacccagagtcatgataaaaatatctgattttatttctgtggtatttatcctattggttagaattttttttttaattttacccccatcacttaggatgtattttatatgagataattttccagttttaatcaccggagtttatttttcagtttatattgtgatagtaagttcattttattttcagagaacctctaatggaaatatattctttagcaagattgctgtatgtttttcacaattctttgggttttaaaatatttgccttttattaaggcaaacccagattagacacatttttgggtgagggtagttttgtatataaatttgattagcaaaaattaataaaaatatatctaaagtgatttccatgcttaaaggattgtttggttgtgttttaatgcatttaatagttcgcttctctatatagaatacatatgttcacacagtaatatatgtacaaactaatatcaataccaaagcttatataatttctgaacatatattttagaagaaattgttctgttcttttctttttataaggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagacaggtaataacccatttaggtaatgtttagtatcatttatgtttgagttctcttcaataactttgattttttttttactcttttttttctatataaagtaaaaaaaaaagtcaagtaaatagtgttatactggccttcagacttttctgttatttgttgatggcttctgattagactatgagtataattatatctttcagtgaatttttaccctgcttttcattgtgaagaagcactacagagagaatttatggaaggtatcagataaatatgaaacatagctaatatgttgttatattaaaaaaaaaataggcaccagcaaatctaaaatgttaggttaagcaaacagttctgctggctttatgttcaacagaagagaggactagagcttgtgagtaaaaagaaaacattaatcttcatgtaataaaattctcttttttacatggaacttaaacattaattttatgattattttctaaagaatcaaaaattgcacaaaattaagagatactttttcagtaataaataataagaatcaacagcatttctcagtgggtaatttatattaagaaaacttcacaatctctcaaagagttttttttttcagtttttcagaaaatcctttctaaatatataaaatactgtgtttaatgatttaataattctaaaaaatcagaatcagtcttatccctaacacaagtctctttatatgaaagttgattcatattagagaaggttactgtgacttgagggctttgtgcaattcatatttagaaacaataaaattcaagataaattcaagggacattttgtgttacattattcaggactaaagtagtaagttattttatatagtccatggatctctctataacagtgtcttatagatttttctttgtagatgctttgtctaaacacatttttaaaaatctgatgggtaactgatttttatttttatgtgaaagaaaagtatagaatgtaagcaacaaattattgaatgtccactgttccttttgctttctttcaaaaccacgttgtgtttacttcctttcttacataaagagtaaaacaaaacaaccaaaataccaagcaaacaaaaaaaccaaaaagcaaaaaccaatttacaacacacacacacacacacacacacacgctcgcgcacacacacacacagagtctagatgacttatggttttaatatatgtttcagactcgatcttaagaaaaggtatttcatacgatgaaaaaatcagtaaaatgtaatgaaatgtaaattggaaattatttttttcatttttgtttttttccttaagtaaggtgtaagcattcagtggacaatcttgaaaacaactaaagaaacagaaacagtgatgataaaccaatgctgtgggaatctgtagaaactttgttagcttagctgacagtttctactctcaactaaatgtttaaagaatgatttacactatccatctgcaaattgatagtgactattctttatattctttctaactattcatttttaaatcttatgtaaacatttgaaattaagtataatttttaagggtttattttgttcttctttttctatcccctatgggtaaaaatagtacatagtaaaaaaagtacataaggaagtacaaatcatgaggtagaaaatttcagaaattattggttcttttcaaatagaggaaattagttcaaatatatattaaaatgttttaatttgactagtaattggtgcatacttgtattatctcatttgtgtgtgaacaagaatgagcaaattacatttgagtgttcagaaacatttagttaaataaaatttagatactgtattttatcaaaaactccctcttaattttgcaaatttttaacaaaacttgagtgaaagaataaatgaatgatagcaagcatgattacaataaatcacatcacaatattgcaatgaaaatagttaacagtttattgtgataacagtttataatttcctctcaatgtcaaatccaagttcaaattctctatatttcaactcaatatagacaaaagttgccctgatactaaaaaacttgtggtgctttcaaataacatgctggttaaaaatattctatttagttttcctcaaatcacaaacaatgtcattatgccagtttatttcagaaaaattttggtgtatgtggtatataaccctatatttataaatggtgcatttgactttaaaaatgaagctctagggctctacatttgacatgtgctttcaaggctgtttgaaaatgaaatacactgtggatttggaaaagtgttttggtttcctgatgccaagttgtatttaagtaatttttggcagaattaaaaggtgcaatgatatggcttcttcagtatgttcctgtgcaaatgatataggtatagatttctctagttacacagttttgttttttctaactcaaagaacaactggctttagatctgagactaaaggtttttatttttttttaaatctaattaaagctactaagtaattataagcagggctgaatgaaatttgttcagctgctgtggtttgtgagcctgtacagtgcttggcaggcacaggcgccttggaggaggcctggaaaggaatgtcttgaatgggtcttgacaagcttgctggccatggggtcatcttccataagtgggaactgccgaacctcttgctagcatttgtcaatagcaaagaatccagggtgcagagttcccataaaacgcacattactagctcttgggaaaaaaggaagcctttctttagctttatttttcccttgccattctaagtttctcacagtattagtgagattttagcaaatggtgccctgcctcctttttccccttcccacacttctttctgtgttgacagggtagaaactgaaaggtttgtcgtgtattttgggtaagtgtacaaaataataccttgtttttggtgattcagtattttgttttgcaagtgattgtttttggacgagactgctgttctgcatgattacaggtcttgggaaattttgcttgtccacctggccatgcatgctttgtgtgcagtttcattttctaatgataaggggagcttacacaaagttgtttatttatttttggtcctaagagttttgcactgtgaatgcatttaaagtattttgaaatttgagaattagtgtaatgacatttagacgaacttaaaatttttaactttccttgtaggtccacataacctcaagaacaattactgtgctgtacttctgaaatttttacccaatgtcttttatgaatcttgtagcttgtttaacagagaattagcaatcaattatctgaacggttccattggttttctgagagcatctaagcaatttattgcttatatctcagagccgtatacagaacttttcagaatttgcatttcacttaagggtagcatattttaagaaagtttaaaaataaatttgtttaatgttcagaatggatttttatattttgcattctgatccagttttttctttcctagcttatgtggatataagaaattttaattaatgaggatattgatataaatgatggacaaatttggtatgaaaattatgactgttttaacaatataaaataactctcctattatttagactattctgtggccactagcatgctaagtattatcagatttctaaaaactagggaaggatgacaattcagattctctgttaaataggaagtgagctttttttctacatatttctacatatgaattgtggtttcattgtgatttgaagtctgagcatgaatatatttttggttcaataggacgtgacatttcgcaaggtttagagcagcttgcaggattgataattcttaagagcctgctggcttttaaactctcagaacattgcagtccaagtccctttgatcattctaattatgctttgaacgttaaaaccagaaatttaaaaaacatgttgttttaatatgttcttttggagatacgtaggaattggtataacatgtcatgcatctcagatctattctattcttttttttcttatattccctacattttcttttatactaaaagacaaaaaagcacaggtttaaaattaaggagaatagaaggcatttgaaaccacaacatattcctaaaatgtaatcacaattgtgtttattttttatcagcgtggcttgctttagtccatttagttatccagctattatgtgctctattcagttagtataatcttatgtaatgagttttaaaaataaattcaagtgtatgtaaaattgaaacacaattttgttttaagctatcttctaactacatgttacaaattaaatttttctaaaactggaatcaaatctgcaaattttgatgctttatataaataaaatatattgataacatttggttacagtattcttggtgtacatatgtagtgtttggtttttgtcaaataaaaaaagatgtaatgaattcagaaatagaagttctttcataactgttatgagtaaaactgttttgatcttaaatgatttcaacacacgtgaattcacttaaggtctaattcctcatagccttccttttcattatctggaagagttgtaaatattgccttaaaagcctgcaaaattcagaagtaaaactggaagtagcgggtgccatttgtctctctgacttctctagggttaacgtggaaaaccaagtgctgaaatctggatatactagccgtgacctaattattttggaaaatgatgaccctgggggagtttttgaattttctcctgcttccagaggaccctatgttataaaagtaagtacgaaaaaaacttccatttattctgtgctcacaactttagaagaatgatctcaaagggtttcaacttttgtggatttgtttttaaaggaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagaggtatgggattttatattttctttgtgtttctctgtaagattgatagtatttggtatattatgaatataaatattttgaatattggcaaagagacaggaaagaggtgggcaagaaaagactgagaagtacatagatttggaaaatttttaacaaaaggtttaaaaatgaagactcattcatattagaatggtgtatttttgctccacatgaagaaataacaaacaatcttagactttcagtgtgtgatcagttttcatctccttttagctttattcatgttaaggcttcctttaggtaatatgtattgactgaacttttaatgatgtggttttaaactgaagaaattttgctatagaattactttgttcaaaaaaagaaatttgagttttatattaatggaaccaggtatagttctattatgcttactcaccaatacatatgtaactctaattttattttattcacttttgtaagtttaagtgactagatcatcagagataacatccacttttcttaccattttagagtagtatcattgtttctctttttctctttttggacaatgtatacgtatttctggtgtctcttaattgataggagaatgttaatttttaaagaaatgataccacctcttttgtcctttcagtgagttatatgcttctgaaactttgagtatattaatattcttgaatatttatgtttttaaatttgttgtgaaaagtcaactttataatttccatactttgacacattcactttagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtggtaatttattctgtgtcttatattgtatttctgtttactgaagaagaaatataatttttttagttatttctttagtaactagttatttctagttgctcaccctgccttagaaattacacatagtgcggaagttttttttagaatcatatttaggaccatgatttttatttcttacatagtatcgtgatgatactgatgacttcagttatattttgataccatttaagcatatgcagtgcaactcaaacactcaagaatgagtccatccaaatagcgagaaccttaaaactaagaactactgctacggaactgttgaggtgactggaaatgataaatagtttatttttagagcagtgtctgtctggataaggaaatcacacttgagcatgcagcttcctgtaactgcttttagcagatatccttacaggactttatgataggtgtgcctaattcgtcatcattctgtttcccatgccaactgacttctaaaatcccaaactagaaaaaaatgagtccatttactttatttattatatacctacagagggaggaacaggctaatatatttttatatgtaccttaaaaactgtgctaagcaaatagttggcagttattaaaaagaggtgttgtttttatttttgtttatttaaccgatttctttactcatcattttaaaagtttcgtatgtcttcatatgtattatgtatgtttccatttcacagctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgaggtaaatattgcatataactttctgccttacttgttgtagttgatcaataattattttttattaaataattaaacatctggtaatatattttgtgataaaagtttgtaataaagaactcaggtgtgacagtgtctgaccataaaccagaagagcagtattatgttttggtttccctgaagacatgttgaactctagaactgagagtggtcagtgacactgctcatgtatccagtatcagggattcttagttggagaggcgaagccctcggcttgtatttagtccctttgaaggcaaggtcatctatcaagtgtcctgtggtgcagtctcagcaccgggacacggggtcgcatgagtcatggaccaaacatggcatttcttcttacagatagtaaagagaaagatcttaataacaacaggaagtgaacctttcctaggagagtgacacttagaacagctgtggaggccagtcccctctccctcagacccattcctcaagagacaaaattcgaatacctttctgttttagggggaggggagcaccagttcacagggatgacgtgaaaaagaaacagcgtccacctggggatccatttaggctcagaaatgtggggaatcaaatcttgttaggacatggagtgaggcctttatgacccatgcagttaaaacttcagtaaggtttgtaagaagcctttgtgagctggctgagctttagttactctaaactctgctctaaatgttcaaaaagttatttttatgtttcatcttaaaaatcaacatgtctcccattttcctgcagaaataatatgacctctgtggtatatcagtttttagcttatataaggcaaaatatctatatttccattaaatttcatagttagtctaaatgaagtggctgtttgtatgaatgcacatgaaactaatttttgggggggtctgagtcttacctgaatgtgttaggggaagttctgcctccgaaaaggaaatgaataatggtagtgttaatggtgcttttttaaaaaaactgaataatttaagaatatatgatgtaatttatatgtataagtcacctgacttaaaacgtgtaacattttccaaagattccagaagaaatggaagaatttaccgttatcctactgaatggcactggaggagctaaagtgggaaatagaacaactgcaactctgaggattagaagaaatgatgaccccatttattttgcaggtggtattgctgtcttatttgaatgagtttacatatttcttaaatagtatatataaatgtatatatgcacgtgcatatatacatttatatgcacgtgcgtatatacatttatatacatatatatttagcaatttttttcattgaacattttcaataaagcacaattgatgcttgtttaaagattttgtaattcattcgaggattgttatttaattgttcgaagttttgactaatacttcaaaaattttttgaagcaaaaagaaaataagtactgttttattatctttttccccctttcagatttctcggtatttttttttcttttgtgcagaaaacacttctccatgtgatttcttcaaataaacagtctagttggttcagggctagattatgtattagaaggacctgagtattatgcctaatggatggccatacactataataactaatttttaagggaaatattaattaaaatttcttcgttttgccactttaacgctttcttcagaactgtctttggccacctgaggcatcttttggttttgtttatgaaacggttgttgtgtaactctttcttgaatccttgttgtcagctatatatgggttaatttacctaatgcaggaattgcaggaatcttgtaagccttttgtattttattgatttgtattctttctttcttcttctttttttttttttttttgagatggaatattgccctgtcaccaggctggagtgcagcggcgtgatctcggctcactgcaccctccgccttctggattcaagtgattctcctgcctcagcctcctgagtagctgggactacaggcacacaccaccacgcccagctaatttttgtatttttagtagagacgggttttcactatgttggccaggatggtcttgatctcttgaccttgtgatctgcccgccttggcctcccaaagtgctgggattacaggtgtgagccactgcgcccagcctgatttgtattcttaaccttcagttaatgtgtacttaatgaattagccttatgttcaaccttctggtaactgctgtgacaaatataaaacataagatctctgggcctgttctcaaggaagttacatcctcaacttagaaatgaggtttatgaaatagtaagcagaggatttgaaatagcatgcaatttgctgagaaattcgatgttgaagataatggatttttgtaggattaaggcaagaggatggccattgactgttgaaataatcagagggtagtcatgtcagagttgggaacagagctaattattttggcaaagacacagtacaaggcttctctcttggagggcagggagaagcacaatgtgatctgaaaatatgtgatggaatcagaaaagctcatgtgttctttctttgtggatatttcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtaagtaaattatgcttttttatggcagatctgcctcagtgctttaataagatgaaattaagcactgcagtccaataatgaggacaagtagggcctaactacatttgtactattcaagagtaaaattatttcattgctttcttgagaaatggggtgaagaatgtatgtgttgaacctttatgtacttgttgaacctttatgacatcctttttaaccttttctttatgatatggcacaaatagaaaattctgatatataagtaagtgaattcttacagctaaaagtaacaggacttgggaatacggcttccctaggtattgcttagtcacccagcgacttaagggataggtatcctgtagcattttccttggagcagggtgctggcacacttgattgggaagcttaattctgtaggcagctaacttcaactgtttgataattctctggagccatggccaaaatgaatgacaatctgcaagtgaaaaagatgtgttcgtccttctccatactgtaaatgaaacaggatgttttaaccccactctttgggatttgagaatgttttggctctaccttctgtaaattggaaaggcctatggcttctcttgatagttattttattcttttaatagtacaaggagtttttttttccttgaaccttttgagagtaaggtaaagacatgatgtcctatcaccctaaatacattagtgtattttctcctatagagatgcccccatgagctctaacgtttgcatcgggtcaccatgatgccctgtctgccacccccagtggaatgccaacgttgtgttccaccttgtgccttttggactgaaagactgaggaagagaaagagatctcttaattattgttttagctgtgtctttcattctccctatctctttgactttcttcattgctgtctctgtttctattctgcttcctctttttctccttttgtctttctctgcctctcatttttcacacagcttaacaaagaagttaaaactaaaaactattatcctgtgaggaaaatttgaatttgtagaataaacccacaagggcaatttcacaattgcaaaaaacatcgtcagatcttacgtagactaaaaacatttggtgaatccattcgttgttctaaaatttaaatgaaaggagttgctacagataaaaataattttagtgaagtaaaagtggaaaacaaagttttactgtgaaatacagaaaagcgatgaaggaatgatattattaatattattattttttacggagtctcactctgtcaccaggctggagtgcagtggtgcaatctcggctcactgcaacctctgcctcccaggttcaagtgattctcctgcctcagcctcccgagtagctgggactacaggtgcacaccaccatgcccagctaatttttttatttttagtagagacaggttttcaccatgttagccaggatggtcttgatctcttgaccttgtgatctacccgcctcagcctcccaaagtgctgggattacaggcgtgaaaaatgatattatcttaatagaatttatttactctagaaataagttcttgatgacatttattaacttagtgtgattctggtaaacatttttgtctcaaaaatatcactgtggttaagctgtcattaggaaaaaaacgccaatatggttaaatagtgaatgaatcaaaacatcctgaaccttttgtaaagagtaggggaactgacatttttttttcttttttgagatgaagtctcactctgttgcccaggctggagtgcagtggtgtgatctcagctcaccgcaacctctgcctcctaggttcaagcaattctcctgcctcagcctcctgagtagttgggactacaggctggcaacaccacacccagctaatgtttgtatttttagtagagacggggtttcatcgtgttggccaggctggtctagaactcctgacctcaagcaattcgcccgcctgggccccccagggtgctgggattacaggcgtgagccaccgtgcctagccagaaattgacgcttgaaaaagaggtttagttagtttgtgaaatatgtcattgggaaaatatatttattaatatttgattttgagagagagagagagagagggagaacacaagatgtgattgggttactggcctgaggtatgtgtgctacctcgtactgctgctgcatttgtctttaatatttttccagaaatgatgacatttgagaatccaattactttcgttaagaaggctcagatgacaaaaatctctagagcttgtgattttttaatacatcctttcttagctctttcctccttttcgatgtcaaaacatcaaggacttgtgggacccatgatgggacactgtagaggcagcatctctgacatgacctagtgctggcagtggctgtttatcctgatgctaatcatttagagcatatgctctgatattggatcaaaggatatggccatccttcaagcccttgttaaatattgctagttcatcttgcagagaaacagaatgaattttcagcaccactgggacatgtttcattacaaatgcatatgataatagaaccctgccaaaattaggttttattattatttatttttgttagattttattatatgctctttatttattgtcagcgttttctacacaatgatttgctatttttgtgtcttttttccattgaattatcaagtgaagttgagtacagttgtatatttgtataatttttattgataagctggtttgctatatataaaatttgtttctataattttagctgtaggtgttgtatacatctgtttttgaaagtgttagttgcatcagttcagcaataaataaattctgcgcaccggttactgagcatctatttttctagggcatggaattgaataagaatcattagtccaatgagcttatagtaaaattatgtgtatgtctgtatgtgtatgtgtgtgtgtgtgtgtcccaatataatatgatcattgttatgatagattgacaaagagcaaagtgccgtgggagcacactggagaggcacttagcttaacctggggattcaaggaagaattcctggaagagttgttgcttgagctgggttctcaggaatgataagttaggtgagtgaagatgggaaggacttttgctcccctgtgcaacagctggagtaaagatgaagagataggcacttcagggaagtgatgagaagagacccaatgtgtaggcaataacagtgccaatatactgtgcaaagaactggagtagaaaggaatcaagcccaaaccatggagactactttgttctatgtacaaccagatcaaactttgctgcctgaaggcagagatgtaaagggaaacactcaagccagtgattccaatgaacacagacagtagtatttttatgttattgggtagtcctttattatttgtatgaaataaaagaatccacctaagaaatttgaaaatagaagaaattatgtttttaatttctaattaagctattgaaggtatattccttttgtgaagaaaagtgtgtttttcaataaaatagttcatttgtaactaaaaaaaatgggaactatttcatcttgaaattatgtaggcatctctctttctctctctctttgtatgtatgtttgtacttatgtgtgtatacataaacatctttggaaatatggagcagtattttgcatttattatatgaccttcagtgaggaaattcttgctgaaattttcaacttaattgtaaactttcttaatttaaaagtataaattttacagcaagttagctacttctttgttattttgtcttttccacttttaatttaggtgatacagtagtatatcaatatggagtagctacagtaataattgaagctaatgatgacccaaatggcattttttctctggagcccatagacaaagcagtggaagaaggaaagactaatgcattttggtaagcatatgtagataaggcaagtttaaaattgggtgaaataaaaccattaagtatgtgaaattctgaaatattccttcaaaatttaaaaattggttaagaattgagtaatttcaaagttggcagtctgaatgagtggtaaactttgtttatgctgttgccacttatcttcaaaaaaaaaaatcttttagctagtaagcagaaattattctccccacccccctcgttcaaacttcaatcctttgtgagactgagaaacttgaattattcaagatcttcaggaactcttctctcagatgatatgtgactacccccaccctgtactttgcttttggaaaactttttccaactgtcatttagtattttttgatggagcttagaatttatctttcagtttggattttgaagacaagacttttatgactgtttctcttttattaaagttctaccttattcttctcttcccatgaaattcttcatagtttgcctcgtagaaccagctggtttgtttcttttaagacaatagatagtaaaaatatgtttccttaataacacaggaagctctcattagagtaagattcactacttataaattttctttaatttattttgtaggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtactgtgtttttccatgtcttattttatttccatgtcttatttatactaaattttacattttatacttagataattagagccatatacaaaatgcaattggtgaagtatttgtgtcatgactatctgattttaaatgttaaaatacccttcttgtttcaagtgttattcttaacattcacttttttgatatcttagtttggttcagttttagggatggaggcctacatccatcctcaaacatgcaaatagactttctccacaccaactatagtgtctccaacaagacgttagtggaaggtaggaggtaaggattcatggtagcttaaagcttgatctttgtgtcataatttaagcaatcaattttcgcatcacttttggttttaaaaagcacagaattaaacctttctaattcatatactcttttcaggcttgactgattatcaataaaattatgctgaacaaatattatttcatatcctgcccctaaaatgtggtgaaagccacatggtgacactacttttcattgataatgagtaaattatttaaccagaagtttgtctgctaaacaaattcttttttcttcacattatactagaaagtacttgaaattctagtttctcactcataaattttcttgttacaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtgagggtcatcatcacaactaggacactgaaatttgcagtttctaaaatttttcattaaaatttagatttttaaaaaagtgctaacatgtatttgaaaactctacttatgcattggtttaatttctttaatcaaaactatgtgcctaccaagataatgagaaattctgtcctgagtgttacagaaatgaatcagagaattttgcccttaaagaacctggaataaaccctagcagagagatgtgtgatatatcacaatgacaccctgtaggaagacagaaaaaaatatgaaagaggaatgtttgtccttctgtgggtagtaggagagatggggagtgatattcctgcagaggaatgaacaaaggaatagaaatgtgaaacagcgtgttgcacctggggaactgctgctagttcagtattgctgaaggtagagggtggtgggcgtgaggttgaaaagaaagcaggagagaagaatcacagtgaaaagtgattatagggttcatactatcagcaggtaacttggtgaattctacagagtgctttgaagagatattctttgttgtctttaaactagatcatatgctgattcctcaagaagcacatttgtgtgtgtgtgcacacaaatactggttatatgcattatagtcaccattccctctcagcccctccatcttatgattttattcttttttatatttcgtgaaagatagagtagagcttatatggctatagcttaatagagtattttcctctgaacctcttacattagttatttggttctattttttttcccagagggggaaaaaaagataggcaaaggaaaatgcacgtatctaccaatttcaatcccatggattttggttacaagcactttgtggtattatccactttttggctgtgtgaatacctacaagtatctgttagccttgattcttttggtgatggtagtggtggtggaatgagaatggaaacgattgggggaagtgggagctggtgttttttcctctgacttactgcagaggaacttgttatttttgtactttgtaatttggaaagataatttttaaactatatgtaaagttattgaactgtagtgccctttatattataaaaatataaaagtatgcatattgtaagtgtacagataagtgaaatttttaaaacttaaattcatcagtttcagcactcatgtgatcagcccccagaccaagaaacagcattccagaagccccctttgactcctccagttgctaactcaccaccctgcctactgactattggcatttttaagagcttaagattcacttttcctatttttaaatttatataaatagaactgaacagtatgtacacttgagtgtccagcttcttttgctcagtattgtttgtgaagttcatccatatttttgcctgctgtagatatttcatgctcattaccatatagaattatcttatgtaactgtaacacaatttatttattagtgctactttcaatttctgttttggttgttttctgttctgcctactacatatagtacttctatggatactcttatacatgttttttgatgaacatatgcctgccatatgcatttctgttgagcacattcctggggatggaattgctgaatgacagtgtgtgcaaatattcggttttagtagataatgcctatcctttttccaaaacagttgaacctaattatactctcacctctagtgtatgagagttccacttaattaatgcttagcttcttccatctttacttttggtttgtagtggcatctcacagtatcataaaaggtgtatttaaaaaaaaataatgctgtgttcaatatagaaaaattgtaaagtacacatatacaacaaaaatagaaatcatttacaataaaaatcatttacaatcattataagaatcatttacagtcattcagagatagccactataaacattaagcatactgttaacatgttcgtatacacacactgtatacatatttcacaatttttcttctttattgtcaaaatgatacatgtatattgcatgaaatttgaaaagtatagaatagtattaagatgcagagtgaaagatgccatattccctccatgaaccactgtaacatattggcatttttataacttttattttgaatgatttagcattgtaacttaagtagttaacactacaagtagagaaataatgatcaggtttgtcccagagaattagtcatagaagcaaagtgcttagaatcctcaaatatgtataatgttttacatttataaggcattttccatacattacctaatttgtacttcataataattcaatatattaaatagaggtcagagtcagtaaataaattcgctagcatcacacaggcaagtaacagaggaaccaagacatgaaaataaaccattaactcctaggtcagtattccttttaacataccatagagacagaactaaaggagatgtgatcatttctatatccttgactccagatagcatcctaacagtgagaaccatgatgtggttttgtgagaatcaggggaacttatatcattacagttgccagataattcaataggagagacaacataggatttcccattgaatctggagctccagtgaaaaggtgtttctggtttgctgggcaggaaggtggtctctgtagtcggtatgggagctgtcatgacagtaacatgccagatacttgtgactaccctgaaagacatctgggtggagatttgtgaaacagcctccactgaggttattgacaagaaatattgcttgtacttttttttccagaatctctgccaatatctcatcttgcctaaagatcttacataaatatcttagttgagttattagagtacgaacaggtaaagaaaggagaactagtgaaagcatgaaaaggtttgttattgagatatagtgacacagttgggctacatgttattattatttttaaaagtccccaagacttacatataatgtttctgagaagaaatatttctatttttacatctattctcttagttgtttggatagagagatatatttggcctgtagaaatacttcttatgaattctcacaactttaactcaatgagtgtctaacatatcaagccttgaagttcttaaataataatatagtactgaagtttaaaaattgtgatgaggctaggtgcagtggcccatgcctgtaattgcgcctcaagcgatcctcccatctaagcactttgggaggatcgcttgaggccaggagtttgagaccagcctgggcaacatagcaagaccctgtctctacaaaaaaaacaaaacaacaacaacaaaaaaagccaggcctggcagtggactcctgtagtgatgtccttgctatttgttagtctgaggtggttggattgctcgaacccaggagtttgaggtcacagtgagctattaacatgccattgcactctagcctgggtaaaagagcaagatcttgtctctaaagtacataaataaataaatacataattaaaaattgtgatgaataagtccatttttaaatgtgcaagagtaaattttaaaataccatagaataaatttctatccaaatacgtgcacatacatacatgcatacgtgtgtatgtatgtgtgtgtatgtgtatgttcagatacttttttttctagaaatgttgacagactgatagaagttacttttaagtatatcatctaatttgaagatagttaccaattcttttagtacaaaatataaatcctaatgattatggattccttttttaaaatcataatagaagataatatccaattcattgtatactagttatgcaaaagtttcatttatccaaaaatatctttcagtaaaattgtcttactttctgaatcacacgtaaaatttaggacaggacacttgaaggtattgtagcatttaaacttgtctctaatttcaggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagaggtaagtagtgagcttggagaattttggatttaaaaattcattgtaggtggatttgtttgggactcggctttctttcatttggtaagattggttgcgcatctactccaagtccagaagtatgctagggccagtgattgcaaatataaattacaaaattcttactcttatgagttcaccctttggatcaacttaatgagctgatagaagtaataacaagttagcaaatgaaactttagcaattcgcctgaaagttaatgctcttcaaagaacgtatgtgtatactctacctatttatttttggctactgttttggatgtcattaaattgaatgaaataatatatattgaaggcttgtatgaataattgtatttgcaactttattaaaatatgattttttgatttttttttttttacatgtgaaacgtacttgagtagttagttatcactttcttccatgttgggtgtaaatacctttcttatcaaccttcttggccagcttaattcattaggctgtcttactgtccttatcagttctttccatgttttcaaagattcgtaatcatcttggtttcctgttcagtaatgtgagaactcatgaaactacttcccaggtgttctgtgtgacagcaacagcttggtgaccatgaaaggatgccaaggaacaagagtctttctttttgcaagttgattctaattggtttagaaggatgtataagtaaattgaaatgattttttaaaaatggatgagtagagtttgaaaaaaaatctaggtcataggctcattctagcttaaactgggatgtctgcctctctggagtgtctttcttgccactttagccctttggtttggtggcagtcttaagagatcttcaaatagtatggtcctttttttacatcagaaatagcatatcctagactagcaataacaaatgtcatacaaatctacaacttgaaaagaaagatgtttacatatagtggataatacctttaaataggtattcagctatcaaagaacttctacatattacattttatgcacctttctgataatccataatataggtgcgttattaaccagtgtgatagtgatattaaccagtgtgatagtgacattaaccagtgtgattattttgtataatatgtgtcaacattttgaagatctgtataactcagtaactagtatttttcaagtaatcaatgcatattgttgcaaatcatgcctgggtaaaagactgttccaaagtacaaggtagaccagtagattttaaagtactagagtatgtttccaggttgcagctaaatgctaagaaactgccacttgtcaaattttggattttggtataatgtcaaggaaaaatacccataattatctgaaaagactagtaaaatcctcttcctttttctgttacacacatgtatatataaggctggattttctttatacactttaaccaaagtaaaagatagaaacaggccgggcgcggtggctcacgcctgtaatcccagcacttcgggatgctgaggcgggcggatcatgaggtcagaagatcgagaccatcctggctaacatggtgaaaccccgtctctactaaaaatacaaaaaattagccgggtgtggtggtgggcacctgtagtgccagctactcgtgaagctgaggcaggagaatggtgtgaacccaggaggcagagcttgcagtgagccgagatggtgccactgcactccagcgtgggtgacacaagactctgtctcagagaaaaaaaaaaagaaaaagaaaaagaaacagacaaattgattgcaagaggagctaggagaatccagctgtcttctattaagccagacattaaggagacttttaaaaatataaaataatacccccttatcactaattttttttcgagaactgtagttatttctcataaaatatgttgtttatgttagcatgtaatgggtttattattgctgtcttaaaatgagttatcaatatttaaatttttaatttttcatttgaatatggaaaatatcagcagattttaatgatatcaacaaaaactctctggggttctcaatagttttgatgtgtacaggggtcctgaaactaaaacatttgagaactgctggtttagtctgtgcttgtaattatcttctgagttcaaattttatgatcacttgcttcatttttagaaataaagactacagccacttccatagattcttctccattatgttgttgcaatgacattgacaatttaacgttaaaaaaaattccctcaaaatttctgaatgcaatagagaccctataaagactctgggctgggcacagtggctcacgcctgtaattccagcactttgggaagctgaggtgggaggatctcttgagcctaggagtttgagaacagcctaggcaacatagtgagacccccttgtctattttaaattgaaataaaaattaaaaaaatttaaaataggccttctgagttatgttatgcttttacctttttcatagattaatatgacataaagtaatattaaggttaaaatgatagcataatgacatcttaaacagataatgaaaatatgtagactctgacatagcctgctatttggcacattgaaagagaaggtaattattctgtgatttgttttctaccaaccaggtacactatgtcccggcaaagagcaggtgcttaataaactataattgaaagaatgaataaaacctgtgaagcagtttagggtcctggtgaggcatgccaaatagtgctttggattccaagtgggatctgtattgaacagaagatggattttgttagatctatagcctagtaaccacattctcatgtttcttccccatattttgttgttctgtgtatttcctatgttattttctctgtaccatattttagcactgtttttacgtgtcctgccaaattgtataccacgtaattataaattaatgaagttgctttcatagtgattcatagaacttgctaatcgtattgttttattttttataactaatacttgcattatatgttatatttataaactatggcttaagaatcaattaaagacactttgggaagatcttcatgaaaacaagaatatcatttcaacttggactatatttgtttttaagtgcctaccatgtgctatgtgaatagattccttgggatataagtgatattggtataatccgatatcaccaatcatcacccatgcatgaaacaaaattaaaaattaattggatttgtagctttaattttctattgcaatagagaaggccaattcatggttcagaatactgcattattttttctaagaaaataggtttcaaaaactcgtcttactatttctgtttattattactgttctgatgatctgaatatttggcaaattcctgacttaaaagaggagacggtagtgagtattattgtgtctagtgagaaactgtttggggatggtttgatgattattatggatgttaggccccttcatatactggcctaaatgtttgtttgtatcataattctaaactcaattagatgaatattttaatattagaaaaaaggtttagatatttattttctatgtcttatgcatttctgtattaataattacataccggagtctagtatttctgaaagtgttgcccttggatgaccttgtcagaaatatctaatgcttattactggacattattcctgactcaggaccccattcctggatcacaatctctggctaggggagaggggaagtttaagctgaattagaaaacctttttaaatgaaagttttcatatatagagtatacacaaaaatagagaagataaaggaatgagtcacagtgtactagcttcaataattatcagccttttggcaatattgtttaatcatttttggttaaacaacttttttttttttttttttttgagacggagtcacgctctgtcgcccacccaggctggagtgcagtgatgcgatcatggctcactgcaagctccacctcccgggttcacgccattctcctgcctcagcctcccgagtagctgggactacaggcgcccaccaccatgcccggctaattttttgtatttttagcagagacggggtttcactgtgttagccaggatggtctcgatctcctgacctcgtgatccacctacctcagcctcccaaagtgctgggattacaggtgtaagccaccgtgcccagccagttaaagtactttttaaagcaaacctcaggcgttatgttatttctctgtaaattcagaagtattaaaggtggatttgcactgagaatcctggtagttttttttttctttttttcttttttttcttttattattatactttaagttttagggtacatgagcacattgtgcaggttagttacatatgtatacgtgtgccatgctggtgctctgcacccactaactcgtcatctagcattaggtatatctcccaatgctatcccttccccctccccccaccacacaacagtccccagagtgtgatgttccccttcctgtgtccatatgatctcattgttcagttcccacctatgagtgagaatatgtggtgtttggttttttgttcttgcgatactttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagctgcatgatttacagtcctttgggtatatacccagtaatgggatggctgggtcaaatggtatttctagttctagatccctgaggaatcatcacactgacttccacaatggttgaactagtttacagtcccaccaacagtgtaaaagtgttcctgtttctccacatcctctccagcacctgttgtttcctgactttttaatgattgccattctaactggtgtgagatggtatcttattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattgtctcccattttgtaggttgcctgttcactctgatggtagtttcttttgctgtgcagaagctcttgagtttaattaggtcccatttgtcaattttgtcttttgttgccattgcttttggtgttttagacatgaagtccttgcccatgcctgtgtcctgaatggtaatgcctaggttttcttcaagggtttttatggttttaggtctaatgtttaagtctttaatccatcttgaattgatttttgtataaggtgtaaggaagggatccagtttcagctttctacatatggctagccaattttcccagcaccatttattaaatagggaatcctttccccattgcttgtttttctcaagtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttgttttggcttaggattgccttggcgatgcgggctcttttttggttccatatgaactttaaagcagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcctttgtaagttggattcctaggtattttattctctttgaagcaattgtgaatgggagttcactcatgatttggctctctgtttgcctgttgttggtgtataagaatgcttgagatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccgtttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaatgttgtcaaaggccttttctgtatctattgagataatcatgtggtttttgtctttggctctgtttatatgctggattacatttattaatttgcgtatattgaaccagcttgcatcccagggatgaagcccacttgatcatggtagataagctttttgatgtgctgctggattcggtttgccagtattttattgaggatttttgcatcagtgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccgtttggtcctggactctttttggttggtaaactattgattattgccacaatttcagaacctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcagtggtgatattccctttatcattttttattccgtctatttgattcttctctctttttttctttattagtcttgctagcggtctatttattttgtcgatcctttcaaaaaaccagctcctggattcattaattttttgaagggttttttgtgtctctatttccttcagttctgctctgattttagttatttcttgccttctgcttgcttttgaatgtgtttgctcttgcttttctagtccttttaattgtgatgttagggtgtcaattttggatctttcctgctttctcttgtgggcatttagtgctataaatttccctctacacactgctttgaatgcgtcccagagattctggtatgttgtgtcttcgttcttgttggtttcaaagaacatctttatttctgccttcatttcgttatgtatccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtacgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcattcaggacttgctttttgaatgtgggtgctcctttgttgggtgcatatatatttaggctagttagctcttcttgttgaattgatccctttaccattatgtaatggccttctttgtctcttttgatctttgttggtttaaagtgtgttttatcagagagtaggattgcaacacctgcctttttttgttttccatttgcttggtagattttcctcaatctttttattttgagcctatgtgtgtctctgcacgtgagatgggtttcctgaatacagcacactgatgggtcttgactatccaatttgccagtctgtgtcttttaattggagcatttagtccatttacatttaaagttagtattgttatgtgtgaatttgatcctgtcattatgatgttagcgggttattttgcttgttagttgatgcagtttcttcctagtctcgatggtctttacattttggcatgattttgcagcggctggtaccggttgttcctttccatgtttagcgcttccttcaggagctcttttaggacaggcctggtggtgacaaaatctctcagcatttgcttttctgtaaagtattttatttctccttcacttatgaagcttagtttggctggatatgaaattctgggttgaaaattcttttctttaagaatgttgaatattggcccccactctcttctggcttgtagggtttctgccaagagatccgttgttagtctgatgggcttccctttgagggtaacccgacctttctctctagctgcccttaatattttttccttcatttcaactttggtgaaactgacaattatgtgtcttggagttgctcttctcgaggagtatctttgtggcgttctctgtatttcctgaatctgaacgttggcctgccttgctagattggggaagttctcctggataatatcctgcagagtgttttccaacttgcttccattctccccatcactttcaggtagaccaatcagacgtagatttggtcttttcacatagtcccatatttcttggaggctttgctcatttctttttattcttttttctctaaacttcccttctcgcttcatttcattcatttcatcttccatcgctgataccttttcttccagttgattgcatcagctcctgaggcttctgcattcttcacgtagttctcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctggtgaaagtcattctccatccagctttgttccgttgctggtgaggaactgcgttcctttggaggaggagaggcgctctgctttttagagtttccagtttttctgttctgttttttccccatctttgtggtttatctactgttggtctttgatgatggtgatgtacagatgggtttttggtgtggatgtcctttctgtttgttagttttccttctaacagacaggaccctcagctgcagggctgttggagtaccctgccgtgtgaggtgtcagtgtgcccctgttggggggtgcctcccagttaggctgctcgggggtcaggggtcaggcacccacttgaggaggcagtctgcccgttctcagatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtctgagcttccaggctgctttgtttacctaagcaagcctgggcaatggcgggcgcccctcccccagcctcgctgccgccttgcagtttgatctcagactgctgtgctagcaatcagcgagactccatgggtgtaggaccctctgagccaggtgcggggtataatctcgtggtgcgccgttttttaagcccgtcggaaaagtgcagtattctggtgggagtgacccgattttccaggtgccgtccgtcacccctttctttgactaggaaagggaactccctgaccccttgcgcttcccgagtgaggcaatgcctcaccctgcttcggctcccgcatggtgcgcgcacccactgacctgcgcccactgtctggcactccctagtgagatgaacctggtacctctgatggaaatgcagaaatcacccgtcttctgcgttgctcatgctgggagctgtagaccagagctgttcctattcgtccatcttggctcctccccctggtagttttttttaatggacgcttgacattcgaaagctcttttagaacttaaaaaatttactttattgtacaaaatattcattaaattttctataaagtgttgatatatagcgtgtaactgtacattcttttattagatatgaatagtgatttttttaaactgaaaatattcaggaagctataggttttgatgaaggttttagtaaataaaaatatagttaggtaacttttccctgtgacttttgcaaacaaaatcctcatcttagtcctaaatgctatgtgctaatgcttactgacttgataaaaatttaagtttgtaaaagaaaccattatacatttcttagtgtctctttggatctatttaactaatgcctcttgctgaaaagggaaaagattttatatttacatattaagattaatggtttattaatttaactcatgagatgttacgatccccattttcagaggagactgtgaatgcttgataagtggtagaatgaggaagctcaggactgcttggccttaaagccatactctttccaccacacatttgctcatgtaccattcggctagcatgaaaatcctgatgtagatccctaagtggaaattaaatctgatgttgtattgacacctgggtctcaagctgcattctcctcttctgtccaacatcttaaggttggagtgccctaccttcaggacagtcagttccgccatgacatgatggatggattcttaaaaatcatcacactatgccagatgcataatgagaaacacagaacttatggaaaagatggggttaggaaaacactgctcaaggacttggtcgttgacacttaaaaaaaatagagacctgataaaaatgttgtacacattaaatatttaatacttataaaccacaatagatatggcatattatctttaaaaaactttaagtttacttgtagaagtgggcatcagaaggattgcagcttgtgtgttattgtgaaatgatagaatgagcattatctaaaattggaggaaaattataacactagatgtggttaagtgtggctagtaacacaggtgttgaactgagtagctggtagttgtttgaggtatgtgtttgaggtatgtggcttgtttcacgtgggtacaattttctgtgttcaccaagtttcttgtggatgaaatagcacttataagcaaatgcaagttgaggctgtattcaaattgttccccaatatattatcaattgcattggaacaatttcatgatttcaaaataagtgttatagcagaattaaatgtacttggtcctcttctcctctccatctacactccccctgctgtcgcaactggttttcgaataccatttgtataattatatatttatccaccaattttacatggctttaaatatcatttatatattgataacttccaaatttatgatgtcaatctcatcttttctctaaaattccagactcatttctttagttacaacttgatgcatttctaggatatttatttcatagacacttcaaactaggcatattttaagccctttgattcttacccaaaacctgtgactgatacaggaggaaagtcaaacctgcttcagagatgcctgggcttcatatgttgctacttgctgtaagtgggctgatgcttctctagtgccctaatcagaggtgtttctgaaggtcagagggcagagctgtaaactgtccacttagccatttatcttttgtggatggagaaatggcctgaagtatgaagctactgcttcaaccctgagcagtgcttatggtgtagttgatcggtgaggggcttggaagaatcaagactagagacaaagatgtttggggagaagtcatgtgaatagattgccaggagttaacactgagtatgagggggtgtttcccaaaaggttctcaacaaccgtgaaatcagagtgaggctctgttgcatatcggccagactctcctttgtcaccacagtgccattaacagcatgatggtagggatggaggttatgcataggtttgacagcatgagctccctcttaccaagactgatgtagcaactggtggttgctgaatgtccaaacagcaagcagcagagaccaaagctaagtacttctcaataaaccatttactggtacactgatcccaaccagactttatcactccaaaggaaacagcaattcattcttattggaattaatactttggctaatgtatttactttagcctcctaatacatcctaatacaagcaccatcatctgaaggcataaagaatgccagctttaaccacatggagacccgcatcacacggcctcaaagggactaatatgaaggaggtgtagcaatgggtacgtagtgataggactgattcactggcctcaccatataccatgtcacctcaagtagctggcctcatacaatttaatggcctgttgaagacccaggcacagtgctggcttaaggacagcttcttggaaggttgaagtattgtccatcaggatgcagtgtgtgcattcaatggctggtatctgtttctgtgtccccaataactagaatgcagaggctcaggcagcaggaggtaaaagtgagactgacccctgtctctgctacttttagtgacctactgcctgaatttgtttcctactttagactccactggattagaaattctggttctggcagtggggctgggggaagaatgtgcctgctaggagacaactgagggccccactgacctatcacctggttgttttgggcctctcatgcccatggaccagcaggcaaataaaagagttagaatgttgcccctggtgtactcgatcctctttaccatgagaacacccaggttgctgctgctcagtgaaactcagaggatttgctggaacatctggtgactccacactcattgataactttcgactattgtcggtttgtagacaaatcccaaatctgtcctctccaaaatgtcagcaccaaaatggctctatcttatcctgatcagagatgcttatggttcatatgaaaaatacagatggcattttatatattaaaacttgtatttttatctgtattcatttttggttcttttttctccaaactatatatttgctaacataaaaataaaattgaattgagagactgaggatttgacagtaggaaggccttactctaaatgatattccagctgcttccaccatagagttttaaagcattatcttaaagtgtttagataaaaaattttccacttgaaaaaaatacctctaggtttatatgataaaaacaccaacaaatatattaagcatggtataagatgccctctttgatctgactgttgttcccacactaggcatctctcaaggatctccccatttggcacttcatgccaccccgccaaaatgataccaccaaatatactatattgcttcttatgtctgtgcctagaaagttctctctgatgtcatgttccaccctctaccccaacccccaccccatttggtctgtctgtgctgagcccattataaaattgcaagtttgtctttctctttagaattctacttatccagagaaaggactatgcattaaaaactattttgcaaccatagcatatggcacagtggttggaacacaggaggtatcaatgaatgaattacttgtgcagttaagacattataattctttttgctttatttatctctataatggaatgggagaaaatgaatgattgtaaatatttcttagcagtcaaagtttatctgggggaatgcagaggcctcgttagtcccttttagagaggtagaaagttgtagaattaagtttatggtaaaaggatttcatggaagcattgtaattttgtcactgatttgaattgctatgcacctattaataatttacattcaatttcagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggtaaaccctaccttttttgttcctttgaaagcctcctggaaagcttttcctgaagtgtttgttctgtaatttctttgcagcttttgattgaagtgtcgcttcccattattatttacaactgtaactgatacattagaatttgcttcaaacatgtctgctgtaaaacctttatcaggtagagttagtttcttcatcactttattttgtacagaactttatcatgacatttttgcgttggattttaagtgatttcctatggatctgtctcctatgatagattgggactggggccatgtctaaccccagcatactgcatatgtcaaaacatgtttgtttaattaataagaaaggagaaattgttttttcactttaaattttgaattaaattttgtagagcatggctcagttattcctattccttttataactttttttggattaattgcttgtgctggactcctaaggcccattatgaatctattttctaaaatactgttcctgagcacgtcaggctctccttaggcagacgctagccacagatacattgcccttgcttcttatcctatcacatctcatcatagaacatgcagtttcttaattgggaagtctctacctgttgttggtaataccacggtctttggtacaaaaaatatatgatattatattgataaatcaacgtatcatatatgatgtaatactgatgcatgtataggctactgtcagaaaatgctactgctcagcacctgccttagtctgttgggactgctataacaacataccttacactgggtaacttataaacaacagaaagttattgctcgcagttttggaggctgggacgtctgagagcagggtgcctgtagattctgtgtctggtgagggcttactctgcttcaaagatatggtgccttctcaatatgccctcctcacggtggaaggggcaaacaaactccctcaacactaattccattcatgagggctctatcctcaagccctcatcacctcctgaaaaccccatcttttaataccatcactttggggattagattttaacataggaatttgggggacaggaggataagacattcagactatagcagcatccattatttttaaggaattaatctattcagacttctctttctctttatatgtctatatacacacatatgcacacacacatacaatgttttaatgttttaatttatgcagaaataagtcgtaagtggtaacttcatttaaatataatttagttgccttttgaattttcttctagtaagtaatttctaaatgcctcattgcttagtgcctctggatatttatatttttaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggtaacctgctccttttgcaagaaaaatcctctcttctctgggtgtacttagttttgttaagaacttcttaaggcactttttgcaaatgacggaagtagaatgccttcagacctcctaatttctaaactctttaacttgtatgctactgttttgagagacattgtttatgagagaaaatataaagatcagtttccaaacttcaataatatgttttgaaaagtttttgcaggattatttaaaatggaacaaagtatttctgttcatagctatcaaatttctttaatttaataattatcctatggtgatttgttaacacctaagtaattgaaatactttgtaatttatattttattaagcttcaagaagtgaagctatcactctatattaatttctttttgtcttatgcttaatagtgacaattttctcgattggggaactatcacagatgtctgtcctagtaaattgagaatgttttctgtattggaaaataatatttcttctatgggaatgaatcaagaacatctgttaaaaggtttgggtagaaatcttgagaggcttttcacctttagttttcatagttaggttttgtttgtttgttgatttgtttatttttaagtgttgcaactcctttaaggtgccatttaacctgttctactatatgttctagaatgatttctggagagtctaaaaaaatatgagtaaaagttagaaaatatgtattttaaaactgtatcagtattcctgctattgatgctgctgtgggaagaaaagctttctttgagtaaagacttggaaaattaacaatttaactttcattattctgaaagcttatgaacatattctgtatcaaaagcatgttagttaaatctttgctaaaatattttctaaataaagtccctcagaattttggcctggtgatcaaaataattgtgtaagatcgctttaattgaataagaaattcttgcacagttcattgggacaatgccctggcccctttgtctccactaggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccaggtaatttactcagtccttttgaagttgtatttgcacttgtaaaacagacataatccttctctggaagggatatacactgtacctggaacatagtgactcacgcctgtaatcctagcactttgggaggcaaaggcgagaggattgcttgaggccaccagcatgggcaacgtcgcaagtcactttctctacaaaaaaagaaaaaacagattagctgggtgtggtggtgcagctactctggatgctgaggcaggaggattgcttgagcctacgagttcaaggctatagtgagctatgatcccaccactgcactccagccttggtgacattgtgagactctgtctctaaaataaaaaaagaaaaaagaaaaataaaaaaagaaaagaaaagaaagaaagaaaaaagaaataatctactttatctaattaattggagaatatttatttagaatttacattgaacattattcatacacactgaagtgttttcaatgttgtattttacttgtcttcttagcatttataataatttgggatataacaaacattctgattttacaaatttgtgtacagaatgattgtaatctattcatatacagaatgattgtaatctaatggatcagtcttttatatttcagaatgttgctggcacattagaatttcaaccaggagaaagatataaatacattttcataaacatcactgataattctattcctgaactggaaaaatcttttaaagttgagttgttaaacttggaaggaggaggtaaggctggtgattcaaaaatgttaaatatttgcttgtctacccatgctgatgaaagtagattcctttagggaagtaagttcctttgaattaatcttacttaaataaatgaataaattattagtttttgaagagagcagcctgaaagttaataattgcttaagatacatgataatatataccataatatatgtggtaatataatctatatcaatcatttttgattgataatccctttcttggtaaaaagaaaattttcctctttacataaacttttagaattagttttagaaattaatattcaactcatagtttcacattgatatgctttcgctatgaggtttggttaattctgagtaatatctctgtttattatatggacagcatgttcgtgctatttttcccccttattattacccactgatatttttctagaagagacgtgcttttagagtgaaaagtataagtgtactaagtcaccaaattacagttttcattcatggtaggttcccctaaggtcacctctctcttttctgttttttgctgtagctctgctagatctatctacagatataacgctgtaaaatctggtccttttggatgatctataatgagttgattattaataaaagaagtcaacaataccttaacttcagttctgctattcagaaagctctgattatcaagggttattggagtcaaacttatttcatgacagaactcatctgcgctaagtgaggctattgataatatgtatcccaattagatggaatactttgcaaaagtgttaatgtgtttatcaggtgctactgggagtgttatggaatacatacgatatgcattgttaattacctttataagtttgagaaattgagagatgatatggtgtttatcaggacagtccctttcattacaaaacccggtatcattacctcattattattatttattattttgatgaagaaagccatagtacataagccatccaaaggaaaaattggtaggactgagatacgaaaattgtctttatgtataaaatagataatttgggtaaatatgcaaaaatttttctttcctgtgttcccaaatctcaggtaagagcaaggagaccaagccagtgtttgggagcagggaagtggttaaacagtgctgagcttggttgaatgcataaaacagtagaaatgtgctgtctagtaggtggcatataaaaataccagcttttcttgtcttccagagacaagtccttgtatctccaaatcactatttgcattactaaaaaggttactataaaatatttgaaaagttgccctttgtgtcacttaaagctaaaaatccttatgtaatagaaagagaaaatgttagtgaccatgagctaatactgattaataattgtacatgaaatgttattgagatgataataatacttgtgatcatatgaccacttatagtgacacttgttatattattgagaaacttctccccatatctctagaatatgcattgttatatattaattggacttgaatactcactagaaaaccaaccttgcagttgcgtaggaagcaatagtggccgagaatctgatttatccctccgtgagttgggattggaggaaaaggaatttatacaatgacctctactcctggactcatatgtagggactgtctaacatgtcaagtagcttatagagcttaattctttggagagtcaaggacttatttcatgctttttgactataaaactgatgaaactgatgattctacataaggtagccacaacctgaatagatgtcttacgctagccaaagtatatatggtgttgaacttcttttttatgacttctggataatgtgggagcaaagccatgtaccagatatttgctgcaaatccattttgccttttggatctgtatgatgatttcaggttctgggtgccatacattctcatgtctggtatattcccatcctattgacaggcaaaaacacagggcaaaaggagaagagagggcagatcttacactagcatgtcaatcaaggatattggtagaagcgtatacgtatggatgtggctttgctatttttactctcctttttttctattgctgtcatcactgcccttcctatcttctttgtttgcaaacatttggtaaaataatggttggggtacaagatgtattagagggaaaggtataaccactttctctttattattgccaaagtactttatattttatattttgatgatattatttattttccattattttatttgatctttataactcttagtccatttcgtgctgctataacagaataccacatactgggcaatttataagcaatagaagtttatgtggctcatggttctcgaggctggaaagtccaagactgggggactgcatcttttagggcattctagatacataataacgtagtggaaggctccacatggtcagagaatgcatgtgagagggcaagagagggctgaacttgcttttacaagaaacccattcttgcaataatgaacccactcccaggataacaacattaatttattcatgagggcagaggtgtcatgacctgatcaccccttacaggtcccaattctcaacacggttgcatttgcgattaaatttcccacatgtgaactttggggaacacattcaacccatagcaacaacatttctataataaaagacagcatctttcataggtgaggaaactgagataccaagaagtttagtgacttgctgaaatttttacagctggcatctttcacaaccaggaaagcagaattgttaggtgacttgtctaggactctttccacaatgccagtggccagagggtgatcaagtttgagaatggtaaataaatgtggtggggatttgaatgtgtggatggaaggaaaggttagatgcatttctcaatattgaactggttgttgtgaatggtaaggtgattatcacaggcatattaggcctaagtgtatgattatataatcagataaatatattttaaatatctaagatattagaaaataatttacgttggtgtaaaaaaatgaaaatttaaaaataatactagattgacagaattgggaagtaacagttacagtctacatggagtatttcatgaaactgaatgaaattttgataatttggtagcttgactggtgctataattctactatttaaaatgatccatttcttatggaagaatgcatgttattgggtgaatattactgcattttcctctttgcttgatatgttttaagacctctcaattttctcattgtgtcaatgtgtgttgtgtgggttgtgtctctgtgtctccttgtgaagtagctgaactctttagggttgatggaagtggtagtggtgatggggacatggaattcttccttccaactattcacaaacgtggtaagcagtttttccaaggtcctttactattataggtttttattttaacttctcattttagagacaatactaaccacttattgacacctactatgtgtaggtcctttacatattttatcttattaactgtcacagaaactttatgaagtatgatttccttcatgttgtagtcacccagctagtaagggatcaagtcagaatcacatccctttctgcttccaaaacccagactctccttcttgtatgaacctaatgtagtttcctgattctaattgtgatagaaatttcacttgaatgtcatttataaaaatggttgtttggaaacattttacatagctttgaatacataaaaagaggtcaatagaaaatttgtattttcgttttaaatacatcacacttattctctgtacaaaaaagaactatgaatccttatatgtaaaatgtaatcaaaacaaatggggagtaatcccagcactctgggagaccgaggcgggctgatcacctgagctcaggagttccagaccagcctgaccaacatagtaaaaccccgtttctactaaaaatacaaaaattagccaagcgtggtggcatgtgcctgtaataccagctattcaggaggctgaggcaagagcccaggaggctcttgaacccaggaggcggaggttgagtgaaccaagattgcgtcactgcactccagactgggtgacagagcaagactctgtatcaaagaaaaaaaaaaaagaaagaaacaaatgggaaaaataaataaggaagaaaataaatggaaggatagttggcaattattgaaggtgatattgaaaagaggatgccttttgaagtagatttatatacaaacatgattcagctttttacctcaaatatttttttcatatatgaaaagcatacttagaatatttgtttcttgaagaagagcattttctaatcctcaaatccttcttttttcacaatgtcagattttatattttagtgtcagaactcatgatttcactgccttcattcctaacttccatcagtgcctaatgcaacctctgtagttaattacactattacttttagaattgttcattttctagtctgtagacattaatgcaacataaaatttgaacatactttttaggaaaaacttaaatgctgctttagatcatggcatctttttagctacagaatgggactatttaagatcaggagagatagatttatagtatcatcacatgatgaaaaaataggcctaggattcatgcacgttggaaaccaagaatctgttccgccagaatgggaaactacttattatttcatgaaggtaagagtcattttggctcaagttcttttgaggtcagaaaggtcgtgggagaccttcctcatatactctgtgtggaagaatgttctctttcatagagaagaaaaagaaaaacaagttttccttattcatctccaagtgcttatgcagcacttgtacatcacgttggtgccaaagtagagaaaggtcataaaagcatgaatatgtgtggcacccatttgtgtctgcctttctttctaaaacaaattagaatgtactcaatgaatggaaggactcttttcaaaaagttgttccttggctttttctttgatttgtaaattactgatcatcattttttttttctatttgttggaacttgttcatgcagccagtctaggagtggcttcccaaattctagtgacaattgcagcctctgaccacgctcatggcgtatttgaatttagccctgagtcactctttgtcagtggaactgaaccagaagatgggtatagcactgttacattaaatgtgagtaccttttcttccttcattcctagacactttctgttgttttaaaaactgtactgtgctatgaaagtgtgttttatgctttcctttttttgtgtaggctgaggggaatgagcctattggcacaggcaatacaaattggtgatcaaacagtcgtttggcatttatttttgtctttagtattgcacatggagtcattgtttaattctgaagatccttgaccctttaaggaacataatggagctgtactacaagtatttatcttacatagatttttgtgtttgttcagataggctgtggtaacaaacatctctaaaatatcaatggctagtacaacaaagaattgccttcctccctccctccctccctcactccgtccctccctcccttccttctttccttccttccttcctttctttctttcttttttcgagacggagtttcgctcttgttgcccagtggagtgcaatggcgtgatctcagctcaccacaacctccgcctcctgggttcaagcgattctcctgcttcagccttccaagtagctgggattacaggcatgcaccaccacgcccggctaattttgtatttttagtagagacggggtttctccatgttggtcagtctggtctcaaactcccaacctcaggtgatccacccgccttggcctctcaaagtgctggaaaagatttgtttttcattcgtagtatgtatatgtccaacttaagttagcaaggggctctgattattagtcactttaggcaccaaggctatatctcagcaggtgcttttatcttcttggcggagggaaatgtggatgtgaagaacagcataccagctcttatagcttctttctggaagtgatttacatcatttctacttaacttccttgatcaaagcaggtctcctggctgtgcctaatgtcagtgggtgaagtgcaatcctatcctgtctctctcccataaggaaagaaaatctaaaacatgggtgaactggcaataacaataactctatatgatgtgtgtgtttgtgtacctactctgctttgttccagtagaaattaggaaggattcattgttcagtgactcacaggagctagctgcttgctcagcttccatacgaataatgaagaaatatcactcaaacatatccttctgtactattatggcagattttcaataaactgttgtgcgataaattcaacaccttagaaaggataactaatgactcaggaaagataaaaaaagcgttaagggaaaggatcaacttttataaaattactgtctctaaattttattttgatgtaaccatcatatttcaagaataaataaaaattactcttagttgggatttacttggagaaatttttaaacttttcattcttaacatattattgacaaaagcatatcttccttcttaaatgtattttcttatactttgggtcaaatatgttttttgatgagtttgtttacataaaatattgaagataaaagtaaatgtgatttgttttaaaatgagttttacagatcacttttcagaaaaacaccatttatacattccttgcaatgaaatatataccatttttgcagtgagtgtgaaaattttatgagtgtgcctgaatgtaatatgttgttaatcacatttaatttattgggcataaaagatacacaaaaaatagttataatttaaatagaagctacgtttttttcatcaatttatagtttcatgcaacaatcgcctttgaaatttcaattgtgttttatttattttttttaagagatagagtcttggtgtgttgcccaggctggagtgcagtgacaccatcatagctgactgcagcctcgaagtcctgggctccagggacccttctgtctcagtctcctgaataactgggactacaggcatgtgccactgcactcggcatagtcactttttaaatatcctctatttgtaagactctctgtgggccttcaaagatggatagtatatgacccctgcctgcagcagtcttgtagtctggagaagaacttatataaaataaaattgtgctgctatcattaatgtatttataagcctctaagtaactggctttaatctctcttttaatagattttaatattaagtattttgtaggttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaagtaagtatcccttagtgtgttattattattattagctctcagaatcctgaaacaatcagttttaaattttatttaatagaaaattctataaaaagtagtaaactctaactttgaaaatgtcctcttacaacagtttacctgtaaggtaactggaagccagacacatttttttcttagaaattatgttttaaaagtcagtagaaagtaagatgggaactttaaaattatctagcacactctattataacaaggttggtgtagtcttgaggctgcctctgatttctggatgagtggattcatccactggggttgctgtaacaaactgccataaactgggtggcttagaaacaacagacatttttcctcatagttctggaggctgggaagtgccacgattaaggtgccagcagattcagtgcctggtgagggtctgcttcctgggccttgtggagggttgaggggtctctgtctctctcaggcctcttttacatggggactaaccccatttacaagcgtctcacctccttaacctaagggctccacctcttaatactatcaccactgggattaggatttaaatgtatgaattttgaggcaggagaacacaaaccttcagaccatagtaacacagtagttcagtgacagtattaattaagaatgggccgtgcagaacaggtttgtcagggaagaaggcgaagcggttaaagaggcagtaatttagagtatgatgatttgcagctagtttttgaggtcaaggaactaaattagtttcctactcaatcttgtaactgaaatgcagttttgttttaatggcacagtgaactaattagaagagcatcattctgttgtaatattatgtaaagtgatgattaattatactctaatgattttttcctttttgataacttttcaacacatattaaaatatttctgtaggtaactgttcttttgttataaattctataataaaaatttctctagaatgtaagctacactagagcagggacattctgtttagtttatttttgaatcccgaatgtctagattaatgctggtgcatattaaacaatacatattcttaaatattcttaaatataaatagtagggctgggcgcggtggcttatgcctgtaatcctagcactttgggaggccgaggcaggcagattgcctgagctcaggagttcaagaccagcctgggcaacatggtgaaaccccatctctactaaaatataaaagaaattagccgggcatggcagcacgtgcctgtagtcccagctactctggaggctgaggcaggagaattgcttgaactcaggaagcggaggttgtggtgagccaagatggcgccactacactccaacactccagcactccagcctgcgtggtagagagtccatctctataaataaataaataaataaataaataaataaataaataaataaaataaatagtagagggaaaaccccaaatgagaatcctatttggctgatggaatcttgctgaggtttcttgatgacttttggccagttcttagaattttgatagctttctgtgttctgtgtggatcttctgtctttcagttccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtaagaaaagacatctaaaaagcagtacatacagagggatgtaagcacagagggacatgtatccttgattaacacagcctctcaaagttgcaattaggataatcaactagaaaactagaaatactcttgtatctttttcaagggacaaatctagagtctttttttttggggggggggatggagtctcgcttgattttacaatttttttatttttatttttattttattattattatactttaagttttagggtacatgtgcacaacgtgcaggttagttacatatgtatacatgtgccatgctggtgtgctgcacccattaactcatcatttggcattaggtatatctcctaaagctatccctccccgctccccacaccccacaacagtccccagagtgtgatgttcccctttctgtgtccatgtgttctcattgttcacttcccacctatgagtgagaatatgcagtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagcctttgctattgtgaatagtgccgcaataaacatacgtgtgcatgtgtctttatagctgcatgatttatagtcctttgggtatatactcagtaatgggatggctgggtcagatggtatttctagttctagatccctgaggaatcgccacgctgacttccacaatggttgaactagtttacagtcccaccaacagtgtaaaagtgttcctatttctccacatcctctccagcacctgttgtttcctgactttttaatggctgccattctaactggtgtgagatggtatctcattgtggttttgatttgcatttctctgacggccagtgatgatgagcatttcttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgcgaaaattttctcacattttgtaagttgcctgttcactgtgatggtacttacttttgctgtgcagaagctctttagtttaattagatcccatttgtcaattttggcttttgttgccattgcttttggtgttttagacatgaagtccttgcccatgcctatgtcctgaatggtaatgcctaggctttcttctagggtttttatggttttaggtctaacgtttaagtctttaatccatcttgaattaattgttgtataaggtgtaaggaagggatccagtttcagctttctacatatggctagtcagtttttctgaatgggcaaaaactggaagcattccctttgaaaactggcacaagacagggatgccctctctcaccactcgtattcaacatagtgttggaagttctggccagggcaattaggcaggagaatgacataaagggtattcagttaggaaaagaggaagtcaaattgtccctgtttgcagatgacatgattgtatatctagaaaatcccattgtctcagcgcaaaatctccttaagctgataagcaacttcagcaaagtctcaggatacaaaatcaatgtacagaagtcacaagcactcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaacgaaataaaagaggatacaaacaagtggaagaacattccatgctcatgggtaggaagaatcaatatcgtgaaaatggccatactgctcaaggtaatttatagattcaatgccatccccatcaagctaccaatgacttcacagaattggaaaaaactactttaaagttcatatggaaccaaaaaagagcccgcatcgccgagtcaatcctaagccaaaagaacaaagctggaggcatcacgctacctgacctcaaactatactacaaggctacagtaaccaaaacagcatggtactggtaccaaaacagagatatagatcaatggaacagaacagagccctcagaaataacgccgcatatctacaactatctgatctttgacaaacctgagaaaaacagcaatggggaaaggattccctatttaataaatggtgctgggaaaactggctagccatatgttgattttacaattttgttttgttttgttttgagatggagtcttgctctgtcacccagggtggagtgcagtggtgtgatcttggctcactgcaatgtccgcctcccgggttcaagattctcctgcctcagccttccgggtagctgggactacaagcgtgtgccaccatgcccagctaatttttgtattttttagtagagatgggattttaccatgttggccaggatggtctcgatctcttgacctcatgatccgcccaccttggcctcccaaagtgctggtagagtttttatatatttatggcactgagcttgtagactttgcaaaaagttttggccaaattatctatgaatttgaaagctatgatgaccaaaatatgcacaaatcaatgaaaagtaaactgaggaaaacactggttttctctgagtgtactcctcatttttgaaagggattcacttgtaaatgactactgaggaatgcagggaaaatgggcagctacatgctttcagtgcttggcaacagtcttgtctctggatccctttatcttcttgcttatttatttgtgaagagcaaggaagaggcaacagttagtattaactattttatatataagaaaatgacttcattgccagatgtatatataagaagactgcctactttgatagtgccgtcccagcatccagagggagatttgcctgagaactattcaattcgaatctttctagtgtgctttcagaggaacaggaatgtgaatggatgggatactgtgcttgatttaaaaaaataaatcatctggccataatacttgcttgaaaagacaataaaccaggcccatctaatacctaactggtgtaggctggggtagctcctaggaatacctggctgcctgtagagggcctcacacactgacagatggtggggattggttagtgtactaagacattagtcctcagtcttcacatgaagcacccctcctttccccacccacctttttttttttttttttttttttctctcctgccatcctgagcagtactcagtagcggctttcaatctatgcaagaaagtcttttcatgtccagctgtatcattgatgatgctagcgttcccatatctgtgcagtggtataatttatctttccagtggcattacaattctatttctgttcttttttctaaaagtacacatttttttcttgtagttaagggggcctatcttgtaatgaatgattctctatttatataaatagaccaaatagatatacatctttctgaaagtgaaggaatgaacttgagcacccctaggaagtctttttcgttattttgtgacattatcaaacccatttttctactgagaggcataaaagtcttcttgcttagaataaatgtagtcaatatcctcaaaaaagtatttccaagtagatccataaagtttgttacctgatagtttttccctagtatatggaatgttttgatcatattttagaagtcttaacattttacttttggtcttttcaggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggtatgaagactaatttatgtctctctttgacttgtctgcatgtatagatcatagataatgatctttacttttggagactcagaattgatctgatcatgctttctttcttaacctgctgttactgacatataggacatctgtacacagttattggcagttgttagtgattgtttaaaaaagaaattaaatcaatctcttagcatatgtggagaagtcacgaactattggctttagggtgtgacctggctcctatatgtgttttgtgagtcttaggcaattctttagaaaaataatttaatttatagaaatttacacaaaaatttggatttctgggctttcttgataaataggaaatgtggcaatatcaagttccctttcctgcataacatcagtcatgggaaccaaatagcaactgcccctctggagcaggcttgcactgtgcaatcagcttctgtgctcactggacctgtcactcatgtctggtatagacttgagccctatgggctttgtggtttctacttctatcacagtgaaaaataatttggaaattttggcagagcagaccaatttgtatcacagcatgttactctggtttttgtgggttatagctacttagattgcttaggggggaagagaatccactataggatggtgcttggttaactgttatctctgtttcactttgtatttgaaatgaactctgctctgtctacccttcaggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggtgagaggactggctagtatagaatgacactgtaaatcataccgtatctatagtgactagaacagatggccattgtaacattttggagaggatgtcaaataaattattcctgcaagaatgttcaaactatgctagtgtgaaagtgatccttacagttgacaaaagcaggaatattctagaaatagattgtatacatatgccagtttactactataagacttttttgtacaattaacttgcattgttcaacattttggttaaaaggttaaatacatatatatatatgtatatacacatatatagtcttaatttataatacatttgctctgtataaacttttttctttttttttttttttttgagatggagttttacgcttgtcgcccaggctggagggcagtggcatgatcttggctcactgcaacctatgcttcctgggtttaagggattctcctgcctcagccttccgagtagctgggattacaggcacatgccaccatgcctggctaatttttgtatttttaatagaaacggagtttcacagtgttggctaggctggtctcgaactcctgacctcaggtgatccacctgcctcagcctcccaaagtgctgggattacaagcatgagccaacgtgcccagcctgttctgtataaactcttaacttatatttatactcccttttggcttgggtgtgagccagtcaatcttaagtattattgtggtttttcattcattcattcattcattcacttattcttcaaccattgttgagaacttactatatgaaaaatagcatgcgagatgcatcttcttgatatttccttttcctgatgaagcagcaaggtagcaaatataagtacagtatcagtggaaaagttaatcactaacatacattggctgaagataattttattgtatgaaattcaagtattaacatttagatctcataaaattacttttgatagcatttattctttaatagtataaaattttatacaagttcataaaatttattttgaatgctaattgtgccatttttcacttctaaaatattagatattcattagcacataaaaaacatttctgtttttttctctctaaatttaggtggcattacagtatgtttttgttttaaattttgtcaaataattttatttaagataatgtgggaaataaagcatagtatattaacgctccattaaaatgtatatttcagattttttttaaaaaagttataggacgtaaaagtactattattgaaatggtaaacataaacagggatattaaaattgagtcacatgattatataacaatattaaggagtttaaacagcctgtatgtcttatatataactaggttctgttattaaatgttgatgatgggttattctgttacatgctgggtttgtaagtgtaattggggagttcttttagtccatttatatttcattccattttgttcttgtacttgtatgtatatgtttgatttttttcccttgaatcatttttattctaatttcagaactgtgatgctgttaaggaagttttcactgtatttttaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaaggtatatgagatagctacttgcctctgtgggagtgatgagaattgtggggtggtggggaaggatcccttgcacagttaaatcatttaggttttgtggttttttctatgccataaattattttataggttattttaatgtgttaactgaattatgcttattagtataaagggcctttcatttatcatacctattgttagtgaaatgggtaataaattttacatcactgagctctctaaccccagaaatgcattgctctaatctgtaatttgttacaattagtacttaaatataactggcttttaaattaaagagcatttgtatgatgtatgaaggagctgatttccaggtctgttttttttttctttttttgtgaggcagcattgggctcactgagctccttcagaaatagaaaacaggatcttgggaacttgtgacaagtccctggtatccacagggaattgattgcaggtccttggatataacaaaatccttggatgctcccctttaatataaagtggtgtaaaatataatatttgcatataacctatgcacagtcatccatatactttaaatcatctctagattacttataatacctaatacaatgtaaatgctatataaatagttgctatactggactggtttttaaagtttgtattttttaaatttttttttttctgaatatttttgatctgcggtcttgaatccacagatgtagaacctgtggatagggagggctgactgttactacatttcctcaaaatgtagtcatgtttgttatcattgttactttgtttcagttaagtaaagcaataaaaattaactttgtaattttgttttgaaaccctgaatttgcataccttggaaaatattttcatagcttggttaaaaataagtgttgtttgattgaaaattagcaaggtttcctcacaggagaaaacaaaatgttgggagacaagtgtaattaagaaacaggattgtgtttgtactatgactttaaacatttttttaaaaaactaaagaccacagtcagcattcctcttctctatttgtaattactttgagtgcttaacctgtcttttaattgtcactccacattttagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgagcaatggttctaaatgaatttccgttgccccagtaaagtcatcatagtccatttttatgataaaatttataagaattcttactgtgtacattcttgttaatatacagaaatgtagtttggctttagaaaaaaatagaagttaattggcttgttaatggttgacatgacatacatagactgacatgactgtacatatatatctttttagtttaaaaaatagattttccgggaatatgtgaattttatccctttatgtttgatagtagtgtctttgacaaagcacagaggaaactataaggcaagttctaattttgtaagggaaattttaataatgacccatgtacttacaaccatacatgttggtaagaagcagtggtagctaggaaaatgagtattaattgataaacattttcatatgcactagacaaatcaggaaatatcatcagagaaaattatttgtaagtaaaagtagcataaactttggtgactgcatttatattacattaatcctaatgataaatttataatactgttcctacacttgagatcactattgtaaaatttcataaacaatatactgatattttacatgatcagctaattagaattaggatcagattgagtggttctttttcaggactggttgactcgtgtgctatttaaaattgggaaagttagtatgtttaaaatagttttctctgggtgtgggacaggtatctttattgagattattgattacatcctcatttgggcagttatatattccacaaaattttaaaaaacatagtgcttttctggttgaaaaagtaatgtatactctaaaaacctcaaaatatacaacaaaatgcaggaaagaaactttgttcctaattctatattttagaacaatccattgtatttgttgtttaactttttaaggcatatacttttttttggaaactaattagaggtcatggtacatatgtaatacgctttttgaaacacataataatcattatgttttagagtaaattttaaaaattgtataaaatatttttattatggttattttctagtcagtgatttgaggatttagtgggatatgatatgcttgacggaagatgggaacaggttagtaattggtaacttttctatttcaaaaggaataatgaaaatgtgacgaggagggagtggaaatgaaaatataaagttggatttttccagtggttatgttaactacaaagaaagttatatataaagaaatagcattatataaattaccattaccatgaattataaccttagcatcacacaaaatggactctattgctaacttagattcttagataatgcagactctcttaaagcaatcttgacactgctgtattgatgaaaatgcagcagggtcacaaaagagagaacatgcatttaatctcctttctccttttccctgccttttcttttcccactccttcattgtctctccagaaagtggggagaaaataaataggggacaccttaggctgaatggcagaaagtattggatttagggacattctgtggtgccctatctactagatcaaattgcaaagtagattgcttggacttttgttgctgtcacttgtccctttgagttcctcttttgttttcttccttcattgcactacttcctggagactggtacttgatgctgtcatctcatcgagttactcaaagatgcatctcatttaggctggttcttttgctcagaatttgacatccctttttagttcctcattttgaccacgattccctaagtgttcctggtttttcaggaaggtattgtgttgatatctgattaaaattatcacagtaatgccagaatgagaatgagactccactttcctaaagggagttgtttctaaacaggatatctttggagctcttttcctagctaggtcactgttcttggctaacaaccaggaagtaaagccatgattctttgaaacaattctaccttttaactttcccataattcaaaatgtccttctccacaatctgtcttcattaatgaaattttacagtgtttgatatgtgaaaagatatatatatatataattaaaatttgcttatgttgcccatgatatggaactgttataattcactcatatttttatttaacttttaaacatagaaattattttgggcctttctgagttctctgtgttggtgattttgttactttggtttttattccattgatgtttttataggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggtgggttcctttttttgttaagcatattcattttcttttctatggatgttgtcttttgtctagttctttaaaacttgatagtttttccctttcattattttgttgaactgtgtgtgtgttaatctgcatagaacttctttgggagaaggctttataatgaactgtttagccagatttaggagccttgcaaaccaataccatgttctagcttgccattctctactggtatgattttaaggaagttaaacctgaaatgcttagttttcccatttgttaaatgattcaaaatattacttcataggtttctttgtgaggattaaatgagctaataaaggtaaagtgcttagcatagttcctggcaagtatagcgtatgcccaagggtagctgttggtatcaaacagtgaaacattggtaaccggttaaaaacaagtaatagtttgtaatcagtgaatattttagcctggattttatattgtgtttgtacattttatgaacaaagtgccaaaccttataaaatttctttttttccttaaaaaacagtaattttcttgaattcttacttaatattttacatcatatgtagggttttgcatagatgggctaatttttgtgtgtttaaaacataacagtgtttttgtcttcgagtaagcctgttttggggtaaataggtattggtagcctgtgtttcattacatagtttatctggaattaaaaaaataattttaccttgaatagttaataaatgaaaaggatatagattgtgtacttggacatctatttaatagatgagaaaacaaattgagacatagagagattaaaagacttgacagtgtcagatggttagtggctgtgccagaaacagaatgtattttactgtattaccttttcccttactgtacttccaacttgcaagtttatttatccatgcaaatattcgagccattttcagtactctacttttattaacggtttggaattgcatgttgtcatagcagtaatgagtaaaagtgaataattccataaatctaacctaaagacagatcatcaactatcaaaaagttatttgtaacataatacagagttactgcaggaatagttaataataatgacaacagtaacacttacggagtgttttctgtgtggcagacactccaccttcattatttcacttaagtttaacagcagtcctatgatataggtataattgtatacaccagattttcatacaaggaaactgaatttgagagagactaaatagcaacaattattcagtggtagtgcttatgcccagctgtgtcaaatccaaagcccatgctatatagggcacctagtgaggagagactttgttttgcttgaactcacgtctgctgcagaacctggcaatgcagggacttttggtaaatatttgaagttatttgagttggaagcataatgaatttgagtagcagtgcctgtgtgagggaaggaaattagtgagagaacctgactctgtttcaggttaaagatggacattggttaaagatgatagctgaaatctggaaaatgaatatgatgacttttgtggacagaggaaaaaaaagcaaattatcggaatggaaccatgaagaacatcagactaaggtgctgggaaagaaaaaattacctgagaggagagagaagcctttgctggagaggcagggagaaaccagggagagagtgtgttttcaatcagttacactgattactccgtaatcagtgagtaatcagtaatcagtgtgtctcatactaacatggccaaaaaggggagttagatctcaaatgggccaaataaaacagtggcaatggtagatgaattttaaaggagtattggggataggaagcaaatatctaaggatgacaaacatagaggtcttcaggggttcctcctcaatgtggctttcaggaggctgcctgttcagtgtttgcttctggtctgtgacaagaggattggaaactcttttaacaatttcactttgctgtgatatccaaaagcagtatctatgggctggtattttgtatgtcttttttgtttgcgttagttttttgctatttaacttatctagtcatttattttattctgttttataagagggtcagcctctaatggattaaggcaaacaaaacaaaacacaaatccctgtccttcacagcatgaagttttgagaagcactgcttattggctataacagcaaggagaggagaagcattggatagaacagatgacgggagcattttggatttgttttgttgaagaaatagggggaaggaaaagagaatcaaagtattagtggtatggaaggtacaaacaagagctgagatcaggaaaggatagacgagatttaaggagggacttagagctatactaggcatgcacttttcagcagtgtgatgaaatttcttttctaaggaatacaaaacaatttggatgtctaggatcaatttaatgaattttaactgtagggccactaatgttgtgaaagtgcatcctatgagcctggatggtggtgctagtggtgagttggagggctctgaagacacggaggccctcctgctgggtaccacaacatcttggagaaactgcagatatgaacacctacagtctgtttggcccagatgaacttcacctgaaaacaatattgtagcctcgtcagtttccaacagctaattatctgcaggagaggcaaagaggaaagattattaattaaaataaatggtccaaaggtgttattggttaaaaatctgctttagcatatcaatctaaaacaccaaattgcttttcttgctggcatgagtgctccctagattttttatgttttctacataaaagttggagtcaatttctattttttacttacttttttctcttcattcctaagccttttcctagattataaattatttttttcaaaaacatattaagccacaatagttcagtattttgtgtatgctttatattaccatgaaaattgcacagagaaatgtgtatcatgatgattttatgaaagtgaattaatgaaaacatcatggtgattcttcagagataaccgctaaacaaatggggtgaaaataattgtgccatgtgagcttttaacagtgttaacgttgcttttagcctagtgttggagtttcatttatgtgattagatttaaaatgtggactatgctgaacttctggctctagaatgcatttttgattcatgggaggaattgccttagtctctaacaatgtattgaattctgtagaatcctatttctacattttgtcctaatgcagttggagagctgcccagtggtaaatattactttctttcaaatgtaatggacagaatttagaaatatgggacaatggattttactgtggttgcacactgggtataaatgtgctctttataaatctgtgctaggtgtttctctcagtcacccagctgagcagcagcataatcatcatgtcatgttcgatggattttaaattttttcttctcttagggacagcgtgaatcttttttacacaaagatttgagcaagaaatgtgattctttaaagaaatatatagaaccgctctactggaaacactcaactttttcttaactgttctttttgacagtctgcttcacattattcatattcctataattgttttatcccgttttcttttttgttatagagggcaatttggatagtatatgtatgtcatgtatacacgaatctattaaatatattttctgtattttggttttccattagttttatgtacattgtagttggtgtttatctttgtaaaaagaattctggtcttgaaaataagtgtctaaaacacttaggtttattaaaatgcattcttcattcatattctttatctgcattaggttagtcctagacaccatgtaacagatctgctttagagttgaaatatgtcactaacttttggtaaactctggatttcgtatcaagatgatcgtccagttatgtagtcagacactttgttatgtaagggttgttctgcctttcatcttgggcaaaaactagaaggctgtttagtacctagtaaagtctttgtcatctaaaaataacatactctctcttaagacttttcttctgtcttttcccttaaatttggaaggctaagcacttatttttaagtttttcattttcctgtgactgtttgacttttcatcctggcagaaggtatctttctgatatgtccagtcattttttccaggaggcattttaaatggacctggctcctgggagtctgcaataaagagacagaataaatacctcccttttgattattgcttagaaaaaatttcacactattcttgctgttgacatgatacattttcactaggcttacaagattatgtgtttaagaaatatttcatttatcttttatttatatgtgcttctctatgtgcgtgtgtgtgcgcatgtgtttgtgtatatgtgtgtgtgtatcatacttcaaattatatttttgcagtattttcttgcaagttactttcatagtaactttttaaattttcagaggggatattgatgaactagtattagacttttagtgtttttacatgtagtaagtttgtctgaatattttactttcttttctcctaagcattttatttttacttttacctaaaaatgatgtatttatgcccaaatctctgtgtctaaacttgcaactgcaattttattattgtgattatagattacccttcaacatggaaattttttgacctgcattttgttttcttgccatttgtgttctctttgcactttagtacttcattaaacttccataattttctttttgaaccattaacaaattttgtgatttgaaaagtttgaaaaccatgactcttatgaaagagtcaccagacaacactgtaggtgaaatagcttaataacttcaaagatttttctatgctttttagtaataaatttttgtttttcaatattccaaacttgctctataagaaattctatatattgtacaatagagagacaccagagtttcacagtagtgtctatattttgttcacaagttttacaaatacaaaatttttaaatggtatgctagcaatggctgactatacatagtccttcattttcatcccaatctttggacaatctgatctagaaattcctgtgcttttaaaagataaaactaagacatagtctactaatgtaaaggtaactaattttttttgtattgacacacttaaaatgtgttttaagaagcctttctaatgcttttgtttatattatccactctccttaaaatgttcattttgttaaaattgtgtttaaatttagtatgaaaaattattttgtttttaaattgaaattaagatggtctctaaattaattaattcatgatattttaagaaatcttcctataagaaatatttgtttagttgtcttcagaaataaaaaatgtggcggtttaaaaaatacttgaaaatagtgtttaaagtttattgctttatttctactttttaaaaaatgtttgaagatattacttatatacacaaaagttacttggatagctaactgaactaaaactaactaaaagtgacatttttagtgaatgtttgtggtttttaactatatgtctatgctatacagtttgattaaggatgtcgtcttctaaatctttttaaacatcattctatccttgcataataataattttttagtgatacagttcattggtatttcttagttgtgttcatcatcatataaagctagtgaattgagcatattttcaacaagtcatatggccattagcacgctccctaacagcttactttatgcttttagcaatttgaaagacatgttatgattttcttcacttttgtgaagtattatatggggaaaaaagccaggaatagaagagatctaaaatatctccattatccaggaaggataactgtaactttggcaaagttacagatgttgatgtacagatttgacacctttcctttgtatttctttttataatacaaaatcattgatggtatatgtaagttacaactaaagaaatgtgattttcaggtatttgcaagcatttttatgcatgcattgtgtaaaatcacattgcatatcagtgtaaggatttgtgcccttttgaaaagtgaaggaagaatttacttgtgttactatcatgaggactttattattttctttaatttacagaacacttatgttctggtgcatgttttggagtgtataaaagtttgtgtttcccattttagcatgtgcttttgtaacttttacatattaaatttcctcaagttctactaaattgaagtatttagaagtggggataataaacaataagcatgtataaagattctagaaaattcaaaacaaaacagctttgtaatgttcttgggaaaggtgctgtaatagttgcatgcttgggatttgggttttgttgagttcaaatgtgaagtttattttccattaagtatttatcaatttacacattttacttgcaggagaaattttacaattccatgtgataagaactttccctggtcgaggaaatgttactgttaactggaaaattattgggcaaaatctagaactcaattttgctaactttagcggacaacttttctttcctgaggtaatactgcaaagaaaagtcgatcacaaatatctagaaagaatggtgtattttgaggaaaatgggatagaaaagcagcactattgtagttattatctttctctcttctccagacctacttcgtatgaattctttgatgatgtatttaattgtttttatcttccttctcattgcctcaatattaagccaagccaatattaccctctgccttgagtagtacattggacttttaatgactagtgtccctgcagcacttgtcttcttttctctgctccagttttttctactcaccattgttgtagaaacctctccaactttgtgctttgagatttccaatagtgttacattgctcaataaataagatttatgttcattagctcagcattcaagatcttccacaattagcccctgtctgcttggagcttaggttcccatgtgtcagtggtttttatttatttatttttaagccacagaacttttgtttaaatgaaaatatatttgcctgcacaatttataaggtgaataaaaataaagcaggagatagttcatattcaataacgacagcgggattgatttctttctgtatgacataggggtcgttgaatacaacattgtttgtgcatttgttggatgacaacattcctgaggagaaagaagtataccaagtcattctgtatgatgtcaggacacaaggtaattcagaatttaattttaattttttttggtatattcttttcgtaaaagaaagaaaattgttatctctgtatttaacaattagatgcataccaatttttaaaatgttactttattatgtgtcccctagaaatgttagatcaaaaaaaattagcaccatatgggaatacttatctttatagactaggaaagaagccctgaaacgttttgctaaatggttacttacagaataaaattcatttccgaaggtagaatttttttgaaattaatttgagacttacaagccaatttgaattttggaccaattatatggataaatcaaatttagtctttttttttttgcgacagggtctcactctgtcaccaggctggagtgcagtggcgcgatctcggttcactgcagccgccgcctcccgggttcaagcgattctcctgcctcagtcttccgagtagctgggactacaggcatgcactaccatgcccagctaatttttgtattttagtagagatggggtttcaccatgttggccaggatgatctcaatctcttgatcttgtgatccgcctgtctcgccctcccaaagtgctgggattacaggcgtgagccaccacacccggcccaaattgagtcatttttaagcaaattatctgggtactttcctcagtttctattcaatttctataattctgataaccagtataaccaataatgacagtaatatgtgaagtaaagaaattcatgatcttccacctgaaagaaaaatggaatgtggcttttgttaacctgaagatttgttagagaagtaaatagaacacttttgattaccttaatgtttcagagagtgaggctatgtttccagcgattaaaagctaatgccaaatcactgttagattcctgcctgacatttttaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggtttgtgttactctagaatgaatggggtttccaggcaagtgcttattaatattctacttgtgtggatgaaagccattgctaaaataaatcggggacaggagaaaattaatatttcttcattcaggacagaactttataacttctttatctttgaaaagattaaaggaattatctgttttcacagaaatgctgtgtaattaacaaacataacatttcagcagcatacagtaatttaggctgtctgtgggtctactaatctacactgggcttggccatgggtggctctattccatatgtctgtcattcttctccgggaacaaatggtagcacaaaagaccaagtgaaaatgtgtaaggccccctgaggtctagggttagaaccagcacatcatcatttttaccttgttctattggccaaaacaagtcacatatccaaattcaaagtctagaggcagggaaatatgcttttcccacagtgagacacccatgagccatcacatggtaaagattatggatataggaaggggtgaggaattgggaccaataatactagctactaaaggtgcttttaggaaaggcaaaaaattcacaaggggatattattgtaaacatttagataattataaaacatttttgcaacctattcaattaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggtaaaactcttttttttttttaatcttagggggagatagtttaataagttttttttattatactttaagttttagtgtacaagtgcacaatgtgcaggtttgttacatatatatacatgtgccatgttggtgtgctgcacccattaactcgataactcatatatttttccttattattgtattaaacctgaagtaactacatagaaggtagaaattgatggaagagtctatctataacataagtggtaacatttagtaagacacttctagtaactttgcattttaagacatcaagtttcatgaaaactaagtttacctgagtttttttctattagtaaaaaaaaaaaaaaattactctgactttaatatcaggtttggacactctacaattataataccagaaacctggtgaattctcttctgcttgttccccctgctggtacctttaaatcatcttatttcttttcttgattttgttgttgttgttgttgttttaatcatacaggggtttctgttcttgtttagatagacaggcctgctgttatgtattttattacagacatgtccgtgataaagaattttcttagggcagtcacctttgagatgccatagacctaagaggtttcaaggagtattttgattacttcaaaggattctttggaccagaaaatccgtgtatgtcagaatctttgttggtagtaggaccacttaaattagagatagggagaaactcaccagaggcagatggcacaaaatgcgattatggttacattaagcttagcataatcattaatgattgaaattgcattttaaataatttttcatattgtggaatctcatgttgttttggggacttagtgtatcagttacctaaatacagttccaagaggtttataaaaatggtactcacggagggagtaggagatagtgtgtaggataggggaagggaaagagggagaaagcatgaatattgcagttgagaaaatatttttcaattactatgtattttgggagttctattttaaaatgtattttattatcttggaggcttgtgcttttacagaattataagtggtgtaaaccatctaccaactgaagtcagtaacttattttgttgattactgtggcactgtgacctaatataacagtataaaaattccaaagctgtaaaattaaaggtaatattatgtcagtatatgggatataacacaagatttgataaagctttcaagtaagttatctttcaaatgtatactctattaataacaatataaataaatggattgattattccttagatatgttagtttttaaagcagagaatacacagtcacccttcttttctctgaggagtctagatttttttgaacattgggtttttgtttccacctttatttgatcctagatctttgcaaccttttctgctccctgattagcactaagattaagagactgcaggcctatgcatataggagcaagctgccctggggagtggtagggaggaagtattgcgtggggggtgggggacattaagagtaggcacagcagtccttctatatcactgaccttgtaactcatgttggtccatatattacataagacaatctagagaccatgattttcacttatattttcacatggaaacatgactccattaaataaagtgaggagaaaagcatatgttggtgagtgtgtactgacattatatatgcataaatatacatacacattgtgtttctttgtaaatattgatggctggctgatcactcttgacatggattttgctaatccttatgtttttggtatctgccttgttttcattgctattatgtggactggtgattaataataatagctattaattttaaagcattttctctaggccaccctacacatatgatttgtgatcattattacaatctcccacccaaaaggagctattattgccccgttatagagatagtagaattgggagttctaaaatttaagtaacttacttaaaattatagaatttggtactaggcctccttgaactgcagagcctttttttttttccatggtgttctattcctccttctacacattagatattaaggtaatttcaaatgttttgttcatattatgcttaaaataattaggcttatatatttatataattggtttacatattatataaatctatatttaaaatgttaaaatatttaagtggtttcatgtgggtcaacctaattacttcctatacaaccaagtataagtttaatacgtttatgtttattttttctaatttacatctgtctactttatggttgcatttttgtatcttctgtatactaattatacagtttaatttaaaaacagtttctgagggttaattactttgagagtataactaaaggaatttaatgagtgtaattttttcaggatgatgtaccagagctagaagaatatttcctggtgaatttaacttacgttggacttaccatggctgcttcaacttcatttcctcccagactaggtatgaggggtttcttgtttgtttctttttgctcacttcaaatgaaatgaagaaacttcatttttgaatcagaagtgatcattgtgctgttttgttaatcttagctatgtgttaaaatatgatgggcttttatatttatttttgatactctcatatattgcaatttttacaatgaacaatgtaaagacattaaaaattattgtgtgatgctctttaaattttacaactattttataaacaaatttgtaatcctcaaaatagctctttggaaggtattttcctttcattttcttttaaaattagctgttttcagtagatctccaaactctcagatgtttttattttcttttaggttaagcagtgctgatatttgcttctttgttgctttattgtgttctctgcttctttcatgaccttttatctttttcttttcatgcttttagaaaagactcagttaattcattacagactgaaaggtaaaacctgagccttggtacaaacttatctagattcctttgaaaagatgtattcctatgtttaaacacaaactcctctttcagtgtggacatttactactgggaaattttgtctgaagcctgtaggtgtgatggcccactagagggtggtgctgagttggttagaaggagtgctggacaggggaaagttaatttggattaaaggaagagaagcatggccaggagcagtggcctgggaaacaggcattcctcattcatttctgaagctcactgtgataactttgaaaatattgaaaggaaataatcagtttctaacctattgtttgaataaattcagttcttttgctaaagaaatagatgattccaatgagtaggctgtttacatcaagtattattacaagataattattattcacactaagacaactaacaaaacaattcatatttctttcatcctcttactgagataatttgaatagttaacttctgttgagtggtttctaatgctcctatttcaagtgctttgtagattagtaatatcattacttacattcttctcattttacagatgaggtagcttaggctaagagaagctgcgtaatatgccccaaatcacacagctggagactggtagagctgacttcaatggtgtggtctgattttagaatctctgctttttagcctcttgtctgatggatgcaaaccctgattttatatgctttcctggacagtgttgttcttttcactctacagagaattacactctccctaccctttccccatccaggcagctaccataagtgtcctagactaaggtagcacctctgaaatttaaaaggtaaagaacaaagtattaaaaacaaaaatcaaaaccaaaccaaaacactaatcaggagcaggattagttaatattttaagactagcccaggagcagggttagtaatattttaagactgaaaccaaaaagccaaccaggagcagagttagttaatattttaaggtattggtaacatactaagtttggtggatagaataaaaataaaaagggaagataagtttactttgatattaatctctcttgacttcaccaaactttttccccatctttcccatgtgtctctacttctgtttgtgtccatgtctctctgtgtctcttttgcacacctctgttttctctgtacctttccttgcacttctttcatttatttttcatttttttttgctctttctactccttccaactgtccccattttcctttcctcctgaaatagtgatattatagaatagagatgccaaatatgttttaactaattaaaataatagaaacaaaatagtaatctcagttgtttattattttatactgttctcagttgattaaatttctataaatcagtggctcttgttagccaaaagtgtccttattcagacgtgataagcattgtctctttattttcttaaacatcttttgagtaatgttgataatacctgtacattatgaattatataatttcaaagggactgtctttaaatcctatatcaaaaatatttttaatcatttatatgtattttaagatatgcttctatgttttttaagattcagaaggtttgactgcacaagttattattgatgccaatgatggggcccgaggtgtaattgaatggcaacaaagcaggtaaggccaaggctgcatgagagccctcttctgggtttcatattatttactatctaccaaataaaagtttctaagggaaaaattaattttttttgtttgtttttgtttttttgctatattataggtttgaagtaaatgaaacccatggaagtttaacattggtagcccagaggagcagagaacctcttggccatgtttccttatttgtgtatgctcagaatttggaagcacaagtggggctggattatatcttcaccccaatggtgggtctcaaaatctatcacagatgacttttacaaattattttataatcattattccttgagaattacagtgatttaggtcccatataaataaattattcttaaaaaccattgtatttttcacagtaaattaggacagaagatttcctcatggtaaaatagttcccttaactattttagtaaatataaattgaattttcattactattctaaatgttattctgtatgcattaactatttcattacagtatttgatactagagaatacaagctgtaatattaaagaatttatatcattagataatcttcccagaatgtttcttacacttcacgaaaattttaactctttcatttctttgtttttgctcactgaaacacgtttagtgttttaaaatacttttacttggtctcttcatgccttttatttcttagccaaatgtttactttcttctcttcccctataatttttttggagacaaagtctcgctctctcactcaggttggagtgcagtggtgcgatctcggctcactgcaacctccacctcccaggttcaagcaattctcctgcctcagcctcctgagtagctgggattacaggtggccaccaccatgctaattttttttgtatttttactgtattttatatttttagtgtattttaccatgttggccaggctggtctctcaatctcctggcctcaagtgatcagcccgcctcggcctcacatagtgctgggattacaggcgtgagccaatgcacccagccccctcttaatttttactttttaaacttaatgttgccaatttaaataaaaagatataaaccaaaatataaggagacaaaattcaatgtaaaatagcttattctttacattcacaactatattgtatttctttccaaacattctatagaaactcacagtgtatataaatataatacattctgcttttacctttttgaccagattcttcattttgctgatggagaaaggtataaaaatgtcaatatcatgattcttgatgatgacattccagaaggagatgaaaaatttcagctgattttaacaaatccttctcctggactagagctagggaaaaatacaataggtaattaataatttcttataaacagcttcctctccttcatgctgggttccttaatatgggggaagatgtaaaggaatgagaaagtcttggtggttttctgtgcttaaaatgagaatgattttaagttagagcatttcagaattcctgtgtctgtgtaacagtgcctctcacgtgtgtatgttggtgtatatatgcatgtatgtaaaagacaaagtaggttgatactacagataatattatttcctcagttattgtaggattatttaatttgtagatgtctttcctttggaatttgaattttgttctggtttcctacttagcaatagaaggaattacaaaggtagtaattctacctttgtagaattactttgtacctttgtacaaaggagtaaaggaactcctttagtgtcatctactctgtagtatttccgcatagtgttgaggtatactgatacttcagacagattatgggagacgtaattcttggttggaacagtttgatattgttgctaagagtcatcctactccattgcttgataggtattgtgctgactgtttagagaaggtaagaaagagacaaaggagaaaactcgggaacatacagaacttgagggttggaagggctcttaaaaagtcacttccgttcattctgatgatagacaagccaaatgaatttcaaggattgaatgctgactgacccttcaaactcctgttttagtcagtggctgagctggttttttttaaaaaaaattttagtttgatgaatatttgcattcctgaattattggcctttatggagaaatttgatttgtagtagaaaatataaaagaattctgagtaacccaaggattggtttttacttttcttgctattttgataaaatacattgatatttctaagtccccagaagcctttttttttttttttgaggctgtggctgttgtttcaagttcaaagagtatatgtttgagatcaaatcattttcttgtagaacatagtggggtggtaaagcgttgtatgaatgaataccatgtgttggttgagaatagtctatgtacaaataacagaaaacccaatgcaaatggatttaaacacatataatttattggtttatttaacctgaggatacagcgacatacacctttagatgaggcaggagcaggacttaatgctgccagagatcctgaggttttctgtctcttttctttgccttttggaatattggcttcattgcaaggctaatgttattcattgtcataagatggtgatcaggaccattcttctgcatttcatataacaggaaagagagagtattcaaattcatgcattcctataaggtccttataaaaatctgattgaaattacataggtgacatgcccacctccatgagtaggagaaaggaatatagtattgggctctctcaagcttactttatatttgtaattttctatttttaaagattaagaaattcctcagagcaaaaagtgctttgacagtgagtcgtttcttaaaccatgccccattgattgaccttgagactatttccaaacccttataaagtttcaataaatatccttttacataaatctctatatatgtggataattaagattatctgttgagtacagtgcatgttgagtgaaaggactcatccgttgccttctttgttagttacatttcaatgtgtacatatacgatagtttctccatatccttaccagcaatttctttagtctttaaatttttatatgccatttctaatgactgaaaaatgtgtggttgtattatacattattgtgcattttttctttcattttcctgattgttagtgagcttgacactggtttgttttttttttactttgtgatcctgtttttcgtatcccttatgtactttcctgtggtttttgctttactggtttgtaggaatagttatatattttgaattcaacactttgcctcttaaatatattgcagatatttctcccagactgtcatttatcttttattataatgtctcttattataaaaatttttttaaatttaaaatatcaaatattttctggtatgcttttaaatcctactttcttaggtcttttcacccaaatgctataaaatattttactatattttctactattttcattgttttgatttatatttacattattgcacatatcaggaatttattcattggtagtgtgtgaggcaaggatacaacttcatttttcttctaaaatgcagaaaataataccctcatatcgtacagagaatgaaacatccattagccattaattttcaacatgaaatatctacccttctttttttccttttttctatccatctacctatcattttcctggactctgttttgttctatttgcctatttatgtgctaatagcatactgctttatttatcatagccttgaagtacattttgctagtttttcaggccaaatatttttctttttctttctctaaattatctcacctattccttaaaaaagtctctttcatatgaacattagattcaaactgagatctataaaacaaacaaactattttgattggggttgaattaaaattatggattaatttggatggatttgacatcactgtaatattgagttttccaatttagaaatataaaatgcctctccagtaatttagatcttttataccattgccttcccttgtgttctctcaaaaccaaactgtaagacaaggatttggacaaggatttagtttatttgagaggtgatctctggaggcctgatgagaaatgaggaggtgagagagaggaaagctgatagatgatgtcctaatgagcagtactgctgtgggcaactgacactcagtcctgctggtgttcctcttagacactgggttgaatgaagcttaggactgtcccatgacaaggaaagaaatctgggctgttcatttaccagctcctatttctgatcatttgagagttgctcttgggtgttaaatttgcaacagttctgtccttactcctgcatgggctgatgctgtcttcaggtagagagagaccactaggcaaataggaactgctgcaggtgactttagagtgggtgaaagggaggtgctgacagtgtctgccacagttatacattaaaattttgtgattttcttcatataggttttatagtttttacattaggctaatttctaagtattgttgctattgtgaataaggtctacttttcttttttttttttaaatagctgatctttagagatattataatagtctttaagaatgtatgatctgaagcagactttctgactttgtgcaccaggtctgccacttcccagcttgtaaacttcttcaaattacctgaatgtccttcaatcataggttctgtaaaatgagaataataatataatcaatatcatagggttattgtgagaattaaaagagttaatataggttaagcaattagtaagttcttaatagtattagttgtaattattattaatataagtgacagtaaaaaatagaacactcttgatttgtgaaggttactcagcttgctttgtgttcttactgtagttctaatattttctcttacattttcttagtagacaatcatgtcatctagaaaatagtgacagttctgactctttccactacttttacaggtgttatctggctgatagccctgggacactgttaaatagtaacaattatgacagacattattattttgtttctgtttttagtgggaatgctgctaatgtttcaatatttgatatttgttgttgacttctgagagatactgcttcatcaggttaaggaagctgccttttatcccaagattactgagtatttttctatcatgattgaatatgttattttattaaatgctttaaaaaattctgtcatttttaagatcatcttaagacaatcaccttaggtaaagagttggcctagttttcaattagacatccacacttttttcagcatttataacctcttctattttcatttgttgctttaatatttttattttggcagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggtacagtaagaagctttaatgagaatggaagtttatctttaatatttacaaaataaatttctcttagatgagcactcaagtcctagaatgaaaaaacaatacttccagcttaggtgttagacaaagacatgattcatttactatgtgacaagtgctgtagttctatttactctgtataaagcgcaactggaaaaatttactattaatagggtaaaagaatatgcaaataataaagaaaatatatgtatggctattttaaattttcagcacatttaaattgcatatgtcactttatattgtgtataaaccatataaaagaaaacccaagccaacttttgtaaacattaagtcccagccaatcatttccctttcaccacatttttgttgaacaaaatgtaactgcttacttcagactgcttgtttgacaacaagaatagtttattggagaaaaaaatgctggatttgggataaatatgatctatactcacagtttaccttcccaaacctctttttctatatattaacaattttctgttcctgctactaaactttattttttaaaacagtttaagtttaaaatgcagcacaccaacatggcacatgtacacatatgtaacaaacctgcatgttgtgcacatgtaccctagaacttaaagtataataaaaaaaaaagcaatttgcaagattatgttgcaaatgtgatttttttttttttttttttttgaggcagagtctcactctgtcatccaggctggagttcagtggcgcaatctaggtttactgcaaactccacctcccaggttcaagtgattctggagtgcagtgacgcgatctcagctcactgcaagctctgccttccgggttcatgccattctcctgcctcggcctcctgagtggctacaggcgcccaccactacaggcgcccaccatcatgtctggctaattttttgtatttttagtagagacggggtttcaccgtgttagccaggatggtctcgatctcctgacctcgtgatccgcccgcctcagcctcccaaagtgctgggattacaggcatgagccaccacgcccagctattcccagctaattttttgtatttttagtaaaaatggggtttcaccatattggccagtctggtcccaaactcctggtgccaagtgatctgcccgcctcaacctcccaaagtgttgggattaaaggcatgaaccactgtgccgggcctgtgattattttgactcattttttattgtggaaaaatacgtgtaatataagatttaccattttcaccatttttagtgaacgtttcagtggcattaattatattcacagcaatgtacaaccatcaccaccatctatttccaaaatttttcatcattccaaggacaaactctgtgcccattaagtagtaactccctattactcctctccctagtaatctccagtctactttctgtctctatgaatttgcctattctagatatttcgcatatgtgaaattatacagtatttacccttttgtgtctgacttccttcgcttagcaaaatgttttcaaggtgcatctgtgttgttacaggtatcagaacttcattcccttttcacagctagattatattttattgtatgtatataccgtaatttttaaatccagctatctgttgtttccaccttttgactcttgtcaataaagctcctattattgtgaaaataaaataaaataaaatagctgattatgttagctttaggcatttttcaagcctgctgtagaaaatataataaatctaaaataatagatttaaagctattttgtctaaaacagtccatctaataattatttttttaaatgatcattttatgtaacttcagcacatttgcaaatgcatattcattgtcatggttttttttcacattttggaaatttaaaaccttaattggtttgtgcaagatcacttacatttaaatcttgaaatatatatataaaaattcaaatttgaaatattttattaattttctattgctttattcatgttttttcatctttaaaatttttctcaaatttgttgtttttttttactgtgacttttttcataaaagactcctttttcacagtatagctatatacttttctttttattaggcaaattaaatgttagagcaaattggattaaataaattttttaaccgacataactgtttttattccaaaaagtttttattttgaggtataagtagtaaaatacacaaatcttaagtatatggcttagtgactgtaaagatatatatatacatacatgtaactaccactcagattaaaatatttaacattaaagctgggcgtagtggcacacgcctgtaatcttccgggggctaggcgggcggatcacttgaggtcaggagttcgagaccagcctggccaacatagtgaaaccctatctctaccaaaaatacaaaaactagctgggtgtagtggtgtgtacctgaatggtactcaggaggctgaggcaggagaataacttgaacttgggaggtggaggttgcagtgaacagagtgccactgcatttcagcctgggtgacagcacaagactctgtctcataaataaataaataaataaataaataaataaataaataaataaatgtatttaacattatcatcacccggaagattccccctgtctcttcccctttccagaggaaactactttctgatttctatcattgaagactcattttgctggttcttgagcttcatataaatagaatcatacagtgtgtactcttttgtgtctggcttctttcactcaatataatgtttaggtctgtatggttgcatgcatcagtagttggacattttttttaatcactgagtagcattttataaaatagaccactattggtttgtctgttctcccactgatgaacgttcggatgtttctaatttgtgcctgctatgactacaaatgtttttttaacagtgaaccctagattagaatgagattaatcaagttatgtagccagagcaggacaaaaagttcacaaaaatgaagacatagatgtaatttttaatcaatgttattttaaaatgcactaaatattttttggacactttagtgcagtatatcacaaagttgaaaatcctaaaagtagtaacctgaaacagatgtaaccatcacattataggaatcagtattaaatcaaagtgagatgatatttttcaaaacatgctattttgttgtcagaaatgttcagtagatttcgctatatatgtgttacaaaaatactgtattctagtaaccttatcttttgattttgttttcaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaataggtatagtttattcataaggaaattatcacttctgaagctataagtagggaatattttttgacataagaaaatgcagaaggaaattgatatctgattattttaaaagggatttttaaaatgaactctagaaaagataggtctagagagaccagttactctcctaactgggagtatcaaaaacctaaactcaccctgttattagaatggtgttattagaattcttattttctcagagttcacactttcaggtaaaggtctgtactattttgtgttttaaaaataataaaaagcaagaaataatagaaagcagacttaactgctcaaaccaagtgaatgactcttcaaatatatattaacatgattgtggttttaaaatttcttctagaggctgacaaatatttattttttatatcataaaaatattttaatagatctagtttcattaatatgttaatttcctgactcatttttttcctataaagtgtttttgatacatgtgtgaagaaacataagaatgacaattttatttctttttcagaatatagagtgcaaagttactgaagtaactgatttttagtattttcttatcatctcatcttggattgtgtaaatttaaaaatgtattaagtatatgctagcaatatgatatatatttcaaatatgtagaatgtatactttttctgcttccctcaatccatgtatttctttcagagccacctccatagacatcgaagaagccaataggaccgtgtatttaaatgtatctcgaactaatggcattgatttggctgtgagtgtgcagtgggagacagtatctgaaacagcctttggcatgagtatgtttcatttcttatgagaacaaaattctgtaacgaaaaaatattgcatgtataagatttatattttttcctttgaattgtatgttattgatcatttgaaaatggaaaacagataatctaattcttttattgcatctataaatatgtgttgaggctgggcgctcatgtgttgaggctcatgcctgtaatcccagcactttggaaggccgaggcgggtggatcacaaggtcaggagatcgagaccatcctggctaacatggtgaaaccccatctttactaaaaatacaaaaaattagccgggcgtagtggcaggcgcctgtggtcccagctactcgggaggctaagacaggagaatggcgtgaacctgggaggcggagcttgcagtgagccgagatcgtgccactgcactccagcctggtcaacagagcaagacttggtctaaaaaataaaataaaataaaataaaaataaaaataaaataaaataaaataaaataaaataaaataaaataaaataaaataaaataaaatatgtatttagtgcctatgccaggcatggcactgaactcgtggatcttagaatttaggggatgggggtgacagaaatgaatcaagtaagtaaaaatcaatgtatactttaaactttagtaagtgcttttgtcaaaggagaagttctaagtgttgaaagaatataggggaatgctttcaaggggtattgatctttgagctaagactgaatgatgagtagagattgattatgcaaaggactgggttggaagaacatggaggtgagagtgagaagctgtgaaggcagaaaactgaggcataaaaagcacacataagtgaagaacttgagtggatagtaggtacagaaataaggaggaatgttgagcttggatagctggacaagaccatatcattcaagaacttaaggaatattttatagttgccagtctttataatagtgttaatggaaagccttcgagtggtttaggaatggaggagagttaccatatgtaatgtggtatggtataatcatatatggattttgaagatattattcacagtgccatgtaaataatgggttgatacagaagagaagtgaagatacagggaggcaagatggtggtagcttagactaggtgttgagtatgaaggtgagggacagggaagtaccaaagatgactcaggcttctagcttgtgcagttggatgggagaaggggttcatgctattcattaagatggaattccaaaaaagaatagatgtattttagtaaggggagtaaaataaatgtggtttaacacattttgaatttgagttacttttgagaataaatttctctagactcaaaagaaggtctctgctgggccgggcgcggtggttcatgcctgtaatcccagcagtttgggaggccgaggtgggcggatcacctggggtcgggagtttcagaccagcctgacccacacggagaaaccccatctctactaaaaatacaaaaaaaattagccgggcttggtggcgcacgcctataatcccagctacttgggaaggctgaggcaggagaatcgcttgaacctgggaggtggaggatgccgtgagccgagatcgcaccattgcactccagcctgggcaacaagagcaaaaactccgtctcaaaaaaaaaaaaaaaaaaaaaaaaaaaaaaaaaaaaaaaaggtctctgctggagagataaaccttggaactttagctatatatattgtatttgaagtcatggaaattgatgtaataatctgaaaagaaaggctgaagatggagaagggaagaggacactatagactgaactataagaaggttcaacttgaatggctgaggatatgggatgatggcctagcaaaggagacttaggggacctggtaggaaactcaggagaaaacaggatggcagataccagcagaagagtgctttaaaatggaggaaaaagtaaacggtgtcaacccctggtgagaagtccagtaaaatgagaacctggaaaataattattataattagcaacatagaaggcattaatgaccatagaaagggctatttgtatagaaagatggggaattaataccattttgaatagaggtgaaagaagagagacctcaaatatatgcaaccatttcaagaagtttggcagggaagataggacctggagaaggtagtagtggtgtggtgtcggaggttttttgcatgtttagtttggagagacccaagcatgtgtaggttggatggaaaaggtagagaaatgttaaatatttagaagaaaaaggagataattaatagtggtatggttgtctagaagacaagctgagatgggatccaaaaaagaaagtctggtttctaatttagatttctgcattacgcttggactttgcatgtgttttttggaagtactcatgagagcacatgtcggagattcttaattgttagcagtcattgcttattcttcatttgtggtcgtcttgaattattgtagagaaggatttgtccatatgtcaggaccatttgggactctaaatgaaaaatctgcagtatacctttaaaagggagcaacataaaaatttaaaatgctggatttttaggaaaggaaattgctattggatattacatgtaaggcattgacaaattctcttgaattagtaatctaaaaatgatcaatcatttatagggagcccaggtttcaaccttgatagttgttcttactgcatcatgttcacaccattaaccaaaatttaaaaagaacttaatgttttggagggaagcagccatgttaagagactatacattttttaaaaaatgtttactcctcattagttaggggatttttatttttgccctttttttttctttttttttgtagtacagaattttaaaacatgtaccagttgtagcagtttgataaaaccttgacagccatttgaaatatgtgagtctgcttggcattcttaaaatgtataaaatgtaagtgaaaaattagataggcataatttcaaatttaatagcgtaaattttttaaaccaaatatcatatttctataaaaagtatttattattataaaatttctcagttatattttcatcagctttacagaagttgataaaaatcatgttctgcatatttccctttaaaatatacatttagtatttatttagttagtttttgagccagggtctggccatgtcacccaagctggagtgcagtggcactatctcggctcactacaacctccgcctcccgggttcaagcaattctcgtgcctcagccatccgagtagctggtattacaggcgcacaccatcatgcccagctgatttttgtatttttagtagagaacggtttcaccatgttggccaggctggtctcaaactcttgacctcaagtgatccacctacctcggcctcccaaaattctgggattacaggcgtgagccaccatgcccagccacatttagtatttatttctaaatacaccttggaaaagtatgtgtaggtataaagcagagctttaacaaattttcttggtttttaaataataatttaaaaatattcttatttgtagtacaaattcattatttgtagttattttaaagttttcccacttgtgtcttttcacactcatacacacgtcatgaaagaattttcatttgtagtcacaaatgcacttgtctcattgtttaaacaataaattagaatagataagtttttgaaggagtaataaactagtaaaccatgatttgtgtttttcagggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggtaaacatcagtatttttttatagtacaaaaataaaatgtgcagataaattttagatgtataatgaataactgtattcttattcctcattttctaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtaaaaacattttcatttttaaatagattactttctttaaaagaaattaagatttgtaagattgttcaaattggaagataatgtatgttttatgttaatgtgaaaaaggactttttgtgagttgatatacattttagcaaagtatcttaatccggggatatttttgtctttttaaaatgacacttagttatgtgtagcttggtattaaaattttttaagtcttgcacttcagattttaactcatgctattagtgtgttcagtggctttcttagttcaactctcctttaagttttcattcccactctgtccttgcaggtacaaacaatcattattctggaaagttctcaagtaagatattttacttcagacagccaagattatttaatcattgcaagtcaaagagatgattccgaattaactcaggtttgattcttttaaaatgaagtgggtttttttttgcttttctttttaacattataattgaaatttaccaaaggtatggtctgctggtttagtataaaagaaaaccaaaatttgattgtggtaaagtagaatgtaaagactggttagttaaaagttaatttttaaataccagagtcataaaatgttatattatcttcaagagccaaggataatgtaacaataaaaatgaacatttaattagaatttaactgaattgcaaaacattgtggagaaacatcacacagccagacagagtatcactaaaaattcatgattagcattgccacacaggcattcagtatcacctcagaaatcccacatttctttagtaaactagatcttgtaattctagtaatgcttatttgataacttttgtcactccttaaacttccatacatgcttcacaattccattttcagctaattcccttgttgaagtgaaagctaccaaaaggggtattattcattttcccaacaccaaattcaaaaacccacttgaaacccaatcttagtcctcattcctgctacgacagagaaagtgtcccttctaaaaagccaggcctctcacataagtgcccaccttgtccttataaggtttagctattccctccatctctgacatctctctctctatttggttactacaatcagcctaaatgttctagcttcacccagcttaaaaagaaattcctcccttgatctcattcccttctagttttcatttcatttcctttctcccttctatagtaagacatcctgaaagaattttctacttgttttgtctttacttccccgtgctcaccaatgacaactgcattaccagatccagtgggtgtttttctgtgtaatcattatacattccaccagcatgtgacagtcacctcatcctcaaatataaatcttaccttgctttctaacacactacacaaattttccttttccctttctctctctgggtatgtgtgtgtgtgtgtgtgtgtgtgtgtgtgatccttctcagtccccattgccagttcctcttccctttcgtaaacttagatgtcttggagttttccagaaagattcacttatagttcaaatttcttttttctttctcttcactcacttggatacttttatcaatcctgtggttttaaatatcagcaataggctagcgtattttaaattatatctgtagcctttcctctgtattccaggcctacatacctaactgcctattgacatgttcacttaaatatatttttggtacataatatttaacatatcccaaactgaacctttgatttccactatgaaacttgttacttcagtgctagctttcatctcaggaaatagcaaccccacgaactcagttgcttaggacagaatcctgggatatttcttccttgattactcctttttattagtgggggggatggggtctggctctgtggcccaggcttgagtgcagtgccatgatcacaggtcactatagccttgacctcctgggctctggtgatcctcctaccttagcctcccgggtggctgggtcaacaggcgtgtgtcaccacacctggctgattttttgtattttgtagagatgggatttcaccatgtttctcaggctggtcttgaacttactcctttttattctttcacatcgagtttatcattaagtatttttgattatatgtgtcaataagtgaagacattttgtctctactcctccctactccaggtccccattatttctcttccacaccattatagtgtcctcctagctgttctctgaatttccttgacctcctcagatccattctccattgagtaactggaggcattttttaaaaatattaattgactaatgttatttctgattttaaaaccactcaatgatttgcaattatacttagaataaatttgaaattatttaatatgggcttaacataggatagctatatttcctgatttgccttggaaagtactggattatgcctgttctggtattgttattaatattgcccctttcactctttaaaggatccctgtttaggtgattaattatatggtcatcctaatggaaggtactccatgatgatcttacctctccagccttaactctcatcattctcccagcactatcagattccttccagtctttattcagataatgacaaattttttctgtcttaagaactttgtcatgttgttccttctaacttgatttcccaaataccttcataattctctatcagaccatcctaattgtcatcttcagtacttgactcattttatacttatacattgacttaattattgatatgtttcttgtttaccttttcctaatagttaataagatccataaagggaaaggtcgctgtatccatagttcttagcataatgtctgtggctcaaaagttcctaattgttgactgaataagtataattttctgtgacattgaccagcttgccttcaggtagggtctgaattttaattttgcatttatgaacacttaccctgaaaacttgcatacgttgactgccaccatggggacagaaaggatttaggtgtttctctgtattctattgctcgagcaattgataataatattgcagcattagaatgtttcttattccgttctaaatttttcatatgtagtgtatttcctggttttagctttccctttccctgctgtcaacaacccttacccagatgtacatttgatactgatttcttttcaaatatcttctctttcattcactctgtgtgtgtgtatgtgtacttatgtgcatagacatatatgtgcacactcacacagattagataagggagagagcagcaagggagcatcagttttagtattttcttatttatgaaagtatctttttaactaaataaaaggatccaagagagtaaacatatggtattgattacattcttgcaagtgctaaattcctagtcataaagggttttgtatttcaacatttccttcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggtgagaagataaagtatttgtagtgtatatataattattgaaatcatctagcattcatatggtatattttatatgaaaatgctcttgcaataattttttactaatccatagaatatttcttgatagataagtattaattgtcagctgtaaatggatttttgagaaatatttaagcattatacccctaatcttgtgttctgactactacctgaaagttatatgaaaacaaaattggaagtaggtaggtaaagttgaaagatacatgaatattttatacgcaggatgcaaacaagtaactttttatatgtatttacttgatgtgccatgaataatttatagtattagtaaataatgttcagaactttttataagactctttcagaatattcttggaaggaaaatttgctttctgctgctgagtagaactttcatgggtaaaattgcaacattcctaaaaaaattaaaaaaaattgtccttgttctttctttaacattatatcatggttaatgactaataatgtattcccgtcatgcagtaaatgcaaaaagacttttgaagtacttcctattaacttgtatttttattggactaaatggattctgaggaaatttgtttcttgatatttttattatagttttattatgtaattttgtcatttttttctgtaacttttgcattaagatttgacttctatttcattattgcaggagatcagaattcaattgatattttcatctgggagatgggacagtcttccttcaggtattttcagtctgtagattttgctgctgttaacagaatccactccttcacaccagcctcaggaataggtaaggacttttcaactgctcaccaattctaaaggtagtatggaaagccagaatgattttaatctcattgatttagatttagtatcacattgccagacactgggtatttttttttttttggagatggggtctagctgtgttgcccaggctggagtgcagtggggcaatctctgctcactgcaagctccgcctcccaggttccgctattctcctgcctcagtctccccagtagctgggactacaggcgtccgccaccatgtctggctaatttttttgtatttttagtagagacggggtttcaccgtgttagccaggatggtcttgatctcctgaccttgtgatccgcccacccaaagtgctgggattataggcgtgagccaccacgcccagccgactctgggtattttaataggaatgtaacatcaagagctttacaatactccttccagaaatcctataattttttgaaattcttttgaatttcaattttccttttgcagattaatactttcagaatggacattggcttgagaataatcagaataactaaaatatggaggaaaatattagtgaagaatgaaaataatatatttcttttgtctagagaaacatgaagagtgacattaaatatatatttttaaaatatgaaagtatgtatatggcaatagcaagtatttgcatttatgaattttttttaagttggagaatgactatgagaattcttccatcttcatgaactctcccaacctcctccacagtctgaaatcctttcttggtcttctgtactttaatccacacatcagaaacataagcaatatttttaatcactgtggtttcagaaacaaagtcgattggagagaacccaaggtattattgctgtctgcaggttgtaggattattttagggttggcaaggaatcccttgggtgggccagtgatgataaggagatgaagctgaggccagtggcatggtgagcttatcaagctggctcatggggtgggtgttcatagcacagggaggagacacagacagtgggtcatcatgtctcctgttgaggtgtctagagaatttgtgagccaagcctgagtggctccacaggtgactctggatgaatcatagtcctgcttttaaattgagatatggcaattctgtatgaattaaatggcacacagttattaatttgatattatatgtaagtcaatgttaccatgctatgaagaattcctctacttaaaagccttaatgtatggttggagaagcaagaaaaaatattaagatactaattcaaggtacaggactatattagtccattctcacactgctttagaaaactatctgaaactgggtattttatgaagaaaaaaggtttaattgactcacagttccacagactgtatagaaagcatgctttgggaggcctcaggaagcttacagtcatggcagaagggtgaaggggaagcaagcaccttctttacatggtggagggaaaaagagagcgcgaagggggaagtgctgcacacttttaaacaactggatcttgggagaactcctctactatcacaagagcagcaagcgggaaatccgcctctatgatccaatcacctcccaccaggtccctcccccaacactgaaaattataatttgacatgagatttgggttgggacacagagccaaaccatttcaatgaccaataccatttgctctgtgaggggtagaattggagtgattaagagagacaagagaaagcttgagctatgtctgcgtggattggcaggacacactttgggcagagggaaaggtatgagcaaaggagaaaggcagaagtgtttatagcattgaggccaccattggtagatgaaagtgccagcgacagaggatttgaccagaatgttgtggtgctgagattggagatacaacactggaatctagagaagatggcctggaatggcaggcacatggtgcgcctgtgcctcaaatcatccagcagttttcacacattttgctcttagaatctattcatatttattgtgtaagagattaaaactgagaaatgttaaagtcatctattttaaaatgacagcaatatactcattatgtgtaaatacaacgttatttttaaaaaacactttctaaaacgaacacttttatgagaagagtggcattggttttattttaatttttgaaaatctctttaatgtctggtttaatacatggtatatagattctactttatgtatttaattaatttttttaagggacagcattttgctcatttgtcaggctataatgtagtgatgcaatcatagcttactgcagccttgaacacatgagttcaagccgtactcccacctcagcctcctgaatagctaggactacaggcatgctccatcatgcccacataattaaaaaaaagttttttttaaaagtggagtttctttgtgttgcccagcctggtcttgagctccaggcttcaggagatcctcctgcctcaaagtgctgggattacagtcatgagacactgtgcccaactgattctcctaattaattaacttttttccatctttattaaggcttgattgacaaacattgtttatatttaagatatacaatgtgatattttgatatacatataatgatatgtatttcctcaattgagctaattaacccatccattacctcacatatttacctttttttgatgaaaacacttaaaatctagtctcttagcaatttcaagtatacagtacattattgttaactatagttattatgctgtagattaggtccacagaaattacccatcttataactgaaagttggtagtctttaatcaaaatcccccatttctctcacgccctggcccctggcaagcacagttctacaatttgcttttttgagtttgactttttcagattccacatataagtgagatcaggcagtacttgtctgagtctgggttctcatgtctgcatctgaattcagtctactccagtattatcagtcatttagcctctgctaagttctgtacactcatgaaagaatgagaatgaagtagaaaaacagcattattatgaaaacagcattattttcattttattatgcaaacagttttgacctctgaaatcctctaaaagggtttcagtgtctcttagatccctggatcacactcagcagtagtgagatagagaaatccttgaaggcttttcaatggcaaatgatgatcaaaggcatgttttacaactcctcatagctttggtgtatagaatatgctggatgaagtaacttgcaactgcctgggcaagagttgaagagggcctttagctggggtgagaaattaggaatgaagattcttgtgagaaagagaaattagaaatgaaaatccttgtgggaaagagaagttagaaatgaagattcaacagcacttgatgtctgttcaaatgtggggagcaaaagttattataccttggcaactgggaggagaatggttttaaattaggaaaagacacagaaaatgtctgtagtgggaaatgtgatgaacttgtttataggtgtctttagtttgagataatatagaagcatgtgtaggtggttagtagagatgtggaactagaatcagaaagaaattggagttaaaggtttggattttggagacatccatgcgtggggatagtcgaactcataaatgttaaagtgtacaaagtaaatgatattgattgcgaagactagaagatttagcacaaatacaggagtcagtatttggaatttttcccttaggtgcccaactactgctttctttatcaagcatttaacatttaggcagtgttaccttcagtcacctcaactactgaccaggaatcacggttatttatgtctaacttttaaattagtattatttttaatttacaagttataattatattacacatattgagtgtaatatgatgttttgataaatgtatacaacatggaatattaaatcaagctattaacatatccatcacttacttaacatttttgtgatgatacagttgaaatgtactcttagttattttgaaatatactatacattattattgattatagtcaccctggtgtgcagatctcaaaaattcctcctgtctagccaaaattttgtaccttttgaccaccaacttcccattctcttgctcttccccgccctggtgactattgttgtaccctttgctatgaattcaacttttaaaagattccgcaactagtgagatcatgcagtatttgtctttctgtgcctagcttatttacttggcataatgtcttccagatccatccatattgtcccaaatgacagaattttgttctttttttgaagcagaatagtattccatcgcgtatatataccacattttctttatccattcatctgttgatagatatatagtttgagttcacattttggctattgtgaatagtgctgtaatgaacatgggagtgcagatatccctttgacatactgatttcaatttcttttgacatattcttagacagaagtgggtattgctggatcattctgttcattgttgggggaacctccataccattttccacaacatcttactagtttacgtttctaccaacagtgcatctgcaagcatttccttttctcctcttcttcaacacttatttttgtgtaagatttattctaataggtgtgaggtgatagcttattttggttttaatttttattttcctaatgattagtgatcagcatttttttcatgaacctgttggccatatataaggcatcttttaagaagtgtcttttcaggtctttagcctattttttttttttttttttttttgagacagagtcttgctctgtcgcccaggctagagtgcagtggtgcaatctcagctcactgcaacctctgcctcccgggttcaagtgattcttctgcctcagcctcccgagtagctgggattacaggcacctgccaccatgcccagctaatttcaccatcttggccaggctggtctcaaactcctgacctcatgatccacctgcctcagcctcccaaagtgctgggattataggcgtgagcccctgggcccggcctagcctattttttaattgggttgtttccttgctattgagttatttgagtttcttatatagtttggatattaaccatttatcagatagctgtatgggtttaaaatgttttttcccattctttgggttgtcccttcattttgtgattgtttcctttgctgtgcagaaactttttaatttgatgcaatcccatttgtctatttttgcttttgtcgcctcaacttctggagtcaatcaaaaaatccttgcccagattaatgtcatggggatattccccgttttcactgagtagtttataacttaaggtctttaatttattttgagttgatttatgtatttggtatgaaataatggatctaatttcattcttccacatgtggatatccaattttctcaacaccatttattgaatagactctctttcttcattgtgtgttcttggcacctttgtcaaaaatcaattggttgtgaaagtgtgagttaatatctgggctttctatcctatcccatttgatcagtcagtctgtttttatgccagtaccaagatgttttgatcataattgctttatattttgaagtcaggtagtgtgatgcatccagccttgttctttttgcttgagatcgttttgtctattcagagtgttttgtggtttcatatgaatttaaattttttttatttctgtgaaaatagaaaaatgataccagaattttgataaggactgcattgaatctgtagatcactttgggtagcatggacattttaacaatattcattccttcaattcatgaatatgggatatctttttatttatttgtgtttttttctatttctttcatcagcgttgtacagttttcagtataccagtcgttcgtctttattgctgttgtaaataggcttgttttcttaacttttttggatagctagttattagtgtatagaaatgctacagatttttgtatgttgattttgtatcctacgactttactgacttcagttatcagttctaagagtttgttttaatgcaaactttagggttttcaatatataaaacatgttgtcagcaaacagagacaatttaatttcttccattcctatttaggtatgtcttatttctttctctcgcttaattgctttggctggaactttcagaacgatgttgaaaggaagtgacaatagtgggcatctttgtcttggccgggatcttggagaaaacctttttcaacttttcaccattgagtataatgttggttacttgtttgttatatgtgacttttattgtactgaagtacatttcctctatacctattattttgagagcttttatcatgaaaggatgttgatttttttcaaatactttgcatcaatttagatgattatttggtttttcttctttattttcttagtgtagtgaatcacatttcttgatctgcatatattgaaccatccataaattccaagaataaatcccacttgatcatggtgaatgattcctttattgcattgttgaattcaatttgctattgtcttactagggatttttgcatctttgttcatcagagatattggcctgtaatttctttttttcttatagggtctttggcctttatatcaggataatgctggccatgtaaaatgaatttggaattatcctctgttcttcaattttttggagtattttaagaaggattggtatttgctcttgaaatgtttggtagcattcagccataaaggcatcaggttctgggactttctttgatatgagtcgttttatgactgatttaatttccttactcattattgatctgcttaggttttctatctcttcatgattcagtcttagtaggtgctatgtgtctagacgtttattcattttttcaaggttatccaatttttggcacataactgtggtagtttctcttgatcctttgtatttctgtatttctgtggtatctgttgtaatgtctctacttttatttctgattttgtttgaatctgcactttttttcttagttgatgtagctaagggtttgtcaactttttcttttaaaaaaaaacaattcttagttttatttatttttttctattgtttttctagtcttttatttatttttgctctttgttatttgcttccttctgttaactttgggcttagtttgttctttttctatttcctttagttgtaatattagaccatttatttgagattttatttctttttcaatacaggcgtttattgctgtaaattttcctttttggactgtttttgctgcataccatacattttagtatattatttttatttttgtcataaggtatctttttatttcttctgcaagtcatttattgtttagagtatatttaatttctacatatttgtgaatttcccaagatttcttctgttattgatttctagcttaatgccattatgatcagaaaacatacttgctatgctttcagtgctcttaaatttgttaagacatgttttgtggcctaacatatagtctatcctgaagaatgttctgtttgcttgagaagaaagtgtattctattgcttttggatagaagattttgtatatgtctgttaggtctatttggtctacagtgtaattaagtccagtgttttcttattgatgtgctgtctagatagtcagtttattgttaaaagtgggatactggggtcccctactattattgtattgcagtctatatcacccttcagatcacttaataattgctttattatttaggtgctccaatgttgggtgtatgtatatttataattgctatgtcttcttgatgaatttaccctcttgttgttatagaatggtcttctttgtccctttttatagttttttacttaaagtctattttacctgatataagtatatctacccttctgttttgacttacatttgcaaggaatgcctttttccattccttcattttcactttatatgtgtcgttattggtaaatagtctcttgtaggcagcatatgattggatcttatttttttttaatacattaagccattctgtgtcttttgatgaatttaatcaatttcattcaggataattattaataggagcagacttgctactgccctttcattatttgttttctgtttgttttgtagatcttttgtttctttcttcttctgttgctgttttcctttgtggcttgatggtttcctatggtggtctgcttttaatcctttctttttatagtttttgcttccacagtagttttctgctttgtggttaccatgaggcttacataaaacatcttgtactcagaaacagctattttaaattgataaaaaattaacttcatagcaaacaaaaactatatttttatgttctctcccctaaaacttttatgattttgatctcagaattttttttgtaatttgtatttcctaacagtttattatagctacagttatttttaatagttttgtcttttaaacctgagagataaatttgctttatataatcaccttacattattagaatatcctgaacatgactatattacttataccattcagttttctttaaattttctcatgttttatgttattagttatcagactttcatttaagcttaagtaactccctttagcaattctatagagcaggccgagtggtaacaaactctcttagcttttgtctgggaaaaatttaattctctcttgtttctgaaggacagctttcctgagtaaagtattcttggtagaagtttttttccccttcttcattactttgagtttattattctactctctcatggtctgcagggtttctgctgagaaatctgctaattagccatattgagacgcctttgaatgcgactatattctctatctcttgctgctttcagtattctttctttgtgtttgatttttgtctgggtaaactcttcattgagttgaatttgactggagaactttgagcttccaatttctagatagtgttgtctttccccagatttaggcatttttcagccagtatttttaaaaataatgattcttggtattttttctttctcttctttgggaactcctgttatgtacagcttagttctcttgattgtgtcacataattcctatagaccttctctattctttttcattcttttttatttttgcttctttgactggataactttaagtatcctatcttttaattcactaattttctttcttctgcttgatcaagtctgctgttgaaattttctactgaatttttagaatagtcattgtattccttatttctagcgtttctgtttgtttttttgtttgtttttatttctttgtcaaatttcttattttgttaatgaattgttttccaaattgcatttactgtttcatctgtattttcttatagttccctgaacttcaagagaattattctgaatttttgtcattcattttatagatctccatttcttcaagatccattattggaactttattaatttcttttggtcatatttccctgatttaaaaaaaatccttatgttggcatctgcacatgtgaggaaacagccacccttttcaggcttttctagtgttctgtggtggtgatagaacttcactatttagtctagcttgggattctggttgggttagttggtagtgaccccagacaagtagactttgttatcatgttttgtatttgggctgggctgttacctgtgacctgggatcaaatggaagtgctggctgtgctctgagatccagtgacatctctggttggggtcttcagtaagtcagagctgttgcctgggcgtagtaattgcctctgatcagtgttgtagattgtcttctctggctggatagtgctgtggtttgggatctatatctgcacagggccacctacttggctgggaggctgggtgaggtgtctagattgctacttaactactcagggtaggcaggactgcaggctatgctgcatagatatgcatggacatgggcttgcctcccatactagggtaaccttaagcacagcactgaggtttggtttagtagctgtttagctgctgtagttgagcagagtcagatgctcccctcagaagacattcacacacatgcacatgactccttgcctggcaagggcttaaggagagccccaggatttggttggattgatgctcactagctgagtctgggcaggactagattcagataattgctgacctgcttttaacttctagcttggagcgaagttaaggaaagtactggggcttggctaagtcacagctctgcagctgggtctgagtagggtcagatgctctctttggataatccgtgggtctgggaagggtcagagggtccctttgtggataatgctgacctgcccttgcttcttggcctggaagtggctgtgaaggagatcaccagggcttggctagatcacagctctgtggctgcatctaggtggggtcagatgctccctctgtgaatgatgacaaatgtacccctgccttctggcctgagaaaggactaaagagtactctagagcttggttgggttgcagctcaatcactaagcttgggtggagctagatgtttactcagcagataattatcaacatgccgctatctcctggcctggggaagttttaaggagagcacgcaggctggctgtggaagctggccagggatttgggcctgggaggcctgtcaactgtgcctcattcagagcaatgctgttgggtattctttctggtggtgtgcctccactggccacaaggcagagccgccaccaagatctgcttgtctgtcactgtgagccctacccctgttcgttgtttctaagtgacctcaggtggtctagccctgttgatagctagtgtttccagtggggcaagacaagggagtgttacctgtgaatgggcccagaatgttggggaagctgaatgtctgcctccaactcaactctctcttccctctgtaaaaacccacagttcccggggaatctcttgtgtgccggactgtgctggcttgggggaggggcaacatagtcaaagagaaactgttcctcttacacttcaattgtagctgttctttgtctgtggtccaaggggttgtttcagcctcactcccatgttctgggatattcatcaaggtattcttgtctctgaatagttgcaaattggatttctgtagaaaacggtggagccagagagttcctattccaccatcttgctgatgtcattctatttacctctcactttttatagattgtttctcacattgtactttgtttccatgttttctactccttcctcctcatccctgtggaatgcccataccacattctcccagtccccagccaccttctacctggactattacatcacttcctggcctccacactatctttactttgccatcagagtcctctgcctgtctctgttctgctcattctttccttaaataacttctctttacattgtcaacactttgactcgtcataaatctgttattatcctaagatatacaacttgagtgacttatcattcaacaagtgatttgttgagtaaattatgtatctttcatcatatatttgtttagtttttgtctacctgtcctttaattttttgcctttattatatttgcttttcttattcctcaagtattcaagtggactaactatgtctccttgagtcacttattattattcaaaatagttgcctaatgaatgtttttaaagatgatgagtgctgcctgaagggccattaattaaagttatagaattctctttaaagatttaaaaaatatataataggcatactttctaaaagaatttgcaaaaaattctgccagagacttattaaaggacccattgtgaggtctctttatttcttttgtttctgtgacttgaggctgtagaagtatgaaaagattgtaggtaattatttagaatggcttattatagatctcctgaaagctgaaattatgcattaaataatgttcaagggctttcttattttgaatgtgtcaaatattttattaaaagtattagattggagctataaccatgaggatcacatatttattctggttaatgacttgacagagattattgggtggtgactgaattctttaaatggaagaagaagaatgaatatgacaaagactacaaggacatacaaacttatcttcgctttcacccttttctcctttagtagttaatagatatttttaagtgcaattatgtgccaagcacattgatagaccctggggaaacaagggtaagcaaaactacatataaaccctgcgctgaagaagttttacaagtagcagggaagagagatattatgtataatcatacatataagtttctagttataaatggataactgctatgaaaggatagaatactttcatactacaaaatgagaggacttgccctggtctaagagatgcccagaaaacttacttaaggaagaatcatttaattgagaattatatgttgagtaggagttgaagaggcagagttgatgatggatcagctctaggcaaagagaggtcaggtggtggtggtgagcatgtgcttttagggaactagaaagggaccaatgtggcccaaatacagacagtaagggaacagtgatactgggtttaactgaagatgtaatcagatagggacttaaaggattatggtctttatcctaaaagtattgagatgcctttcttgaggaggtgatggggaggtggagatagagagatgggcagagagaaagagagagcatgtgtgtgtgtgcgcacgggtgtgcatgcatgtgtggctgccatggaggaaaaacttaaatgttagaagagaagatgtctgagaaagagctggaggcgcattctttagagatgttgaaagatgaagcttggaaagtggtaggtgatgctggttagagaagtagattgattcagatgatgtctcacaagtaaaaccacgggggttggtgatagattagatacggagggagacaagaaagaggatgtcaaagatgagccctaatttctgcaactggtgggtgaatggtagtactgtaacttttgtggtggtgattgcttgggagaggaccaggcttttaggggcagagaaaatgagtttggttggaatatgttaagtttgccattcacatgcagagtaagcactactgattatagagtttagaggagggtcttggtttgctgatatacattggaagtccgtgagtacagaaggtcattttactacaggcagaggttatcttggttgagactattgaatcagctcattttaaacttcagagatgttgagatgcccctgaattaatttttttactcagtgtctccagttttataaaacttgatgaaaaatatatggccatttaaaatgcaaatttattgatagcctttttattgactgccttaactttttatgcaacgtttgctgaagtgtgatagtatttaagtccattactataaataagcacgaacagtggttcttgatatgtaagagtaaggatatggggctttccgttgtaacctatgggctaaaattgtagaagaggctcatatgttcttattcttggtgctattttaatatctaaccaatctcatttgatatcttttttttttttttttttgagatggagtcttaatgtgtcgcccaggctagagagcagtggcacgatctcggctcactgcaagcttcgccccctgggttcacgccattctcctgtctcagcctcccaagtagctgggactacaggtgcccaccaccatgcccggctaattttttgtatttttagtagaaacagggtttcaccatgttagccaggatggtctcgatctcccgacctcgtgatcttcctgcctctgcctcccaaagtgctgggattacaggcatgagccaccgtgcccggcctcatttgatatatttatgttccaatgtgtttatctaggtactggaatttgtacatgtttttctatgatttctcattttttctcccagttttatttaagtctggaaattatttagtattgtatataatatagtaagcccccttccttcttaacttgtgtagatataaatatgtcctttggctattttttacttcttttttagaagcaaccctattaactgatatatatatatacatatggacaagatctaactctgttgcctagggtagagtgcagtagcatgatcatggttcattgcaaccttgacctcctgggttcaaacgatcctgccacctcagcttcccaggcagctgggaccgcaggtgcttgccaccatgcctggctaatttttgttttttgtaaagacaggctcccactatgttgccgggtctcgaacccctgggctcaagcaatcttcctgctttggcctcccaaagtgctaggattacagatgtgagccactgcacccagccttgctttgaactatcaaaagtatggtttcctgataacatttcaaaaacattggaagaatatactttaggagtcataaatttgttcatatcctttggcctaattaattaacttgaagaatttatcaagtgaagataattaacatgaataattctgtctctacttaatatttaataattaaatatacaataacaaatatcaaatgtagggaaattattaaatatattttgatcaaccatatatattatctatgcactgaaatcatagacttgaaaactgtgtagaaacagaaaactgtaatagtatggacatggtgtaatattgttaattaagagttttttgtatttatactgtttataactgtgtcaattatgaattcatatgaatgataactagaaaggaaaatgaagcatttcatgatgggattatgagtatgtttcactttttaaaatatcctaatatgctatctaataaatattaagatgaatataaaagagtttaaaattagtttcggttttagcagccagtaatttcttttttattaaatgggtatggaaacctcatcaagctggcttgatcattctaaagcacttaaaaaattattatttacgtccagttatttcagaaattgaagtatatttagttacctcagaaatcacaatggaactttgagattttggaagattttgctttggaaccgatgcagggagtgtgggaggtgacagtttatatctcactcaagttgttttttctttccttcctgcagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctaggtaggttcaacattttttgctaagtatctttatgttcactgtaattttgtatgacagctcatttccaagtcattatttggtgactgaaaaatatacaaaatataagagctatttatcagcctgaaatttggttattatccatgtttctaatatctattctatcaagtttatcagtattacatgaatattttggattaaaattttcgttatgaaatgttgtgattcttccaaacctttaatatcaattaatgtaatgagtagtctactatgtatatatcttaaatttgttgtagttgacttattttgtatatgcttcttatggtagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcaggtaatgatactgaagaccccacacttgcaatgcaaaatgttttatttattgtatttgtgtattagctattattagcactcagcaagtcatagtttgagtgtcatcagcctctctcccttccctttcccctgcctcccttttatgtgcattctagggtgaattctactgacattttgcaatttacagtcttacacactggactctgagtcaacttgtcctaatcattttattttcagattccttttataggattgactttgaaatgttacaagttgatcttggtctgaaagtttggctctgctgttagctgttaccagagagaaaggatgaaatagatgctaaatgcaatatatactgtgtgatatacacatcacatacaaatatattactatcctattatgctttgttacttctgtggagaggggaagagaatgagaggtggggtggggggagggtggaggagagagagagggttgtaattatatgtatgttggacatgtagatgtcttcctgaggaaagagaaccatgcaaatcctaagttacttccgtgcccagatttcatatttctttatcagcaagcaaaaggacatctattatttgcatcatttagtccttttggtaaagtgaattcttacttcttaatttgagttatagctgcagctatcatgtatctttctctgaaatatttttcatatgaggaaaacctaacccaagtttgcctgcacaccaagagcatgtcctcagagaaagtgagcttcggggttagttggatactctaccatgtcattttggcttagattgtttccatctctctactttgccatcacaaaattgactttcatttggttgtttgaaagctgatgttattgttaaggttactatgttctgctcatgttcatttggggcagagagagatattttatgagattctcaaagtaaagaagacatttcccaaaagactctagaaaatggcttatgtctcattgtccagaactgggtaacaagcccactcactcattcattcattaattcatgcagcagttatttaacaaatgcctgttaggtaccagatactgtttcagatgctacagtcatgttagaaaataagacggtaaaattctttattttcatggtccttaaattctagagagggcaaggggagaaaggcagtaaacacagacataagaaaatatgtactatatctgatggtgatgagtgtactatgaagaaatgttaggcaaggaaggcagatggagaatgcaagggagggagtggaggttgtatgtggggaaatctaaaataggatgatcagtaagggctgtttggaggaaatgacagaatgacaaagactggtgggggatgagggtgtgagctatgtaatatctggggtaggaacatttaaagcagaaggacccatcagcaagagcaaaggccctgcagtgtagccctgcccatctggagcaacaaggaggccactgtggctgatgtctgcatgtgataggggatgaggttcaacaggtgcagggccagggctctgtgtcagggatccccatgaccacccacagtttcgatgagtcactaagaagactcgcaggacctagcatttagtcatatccatggctatgatttattacggcaaagaatacaaaataaaatcattgaagggaaaaagctcatggggtgtaaagtccagaggaagccagggcaagcttctaagattccccctcccacccccatccattgacacaggacacacttaattccccagcattgagttgtcacaagatgtataaaatgttgccaaccagggaagcatactagggactcagtgcccaggattttaactggggtctgatcatgcaggcaccctctgcctggcacataccaaaattctagactctcagaaagaaatgaatgttcagcataaaccacaattattacacagtttaggcactgggagccacttaatagttccagaatggtgggaactctcctgaaattccagttcccagacaccagcggatagccgacctgtgaacaagcctttaaggatagcagtcaggtctgctgtgtgaacactttcctgcataagcccattagcattgtaatgagtttgggccctgagggaattagagagcctttgaaggggaggagtagaaaagtgaatgatctgactcacattttagaaggaacaactctgaccatagtatagagaatagattgtaaatgggcaaggacagaaatagaccagttaggaattattacagtaataaatgatggagctatgggaagcatgaatttgctgctcattgagatatggatgactataggaagagcaggtttaggggataagatgaggagttttggatgtgcttaaagtcttgtgtctgttgcatgcaagggtcagaagtttacactactactcaatctggtccattcctggagctaagcgtagtagatcagcttcctctgaggcatctctgcccaatagggatataatgtgtgcctcatatgtaaatttaagtttcctagcagcctacattttttaaaaagtagaaagaagcaggtcacttgattttaatatattttatttaacccaatgtatctgaaatattttttcaacatacaatcaacataaaattattgaggaaatagtttacatttttcatatcttgtcttcaaattttagtgcgcattttacacttatagactagctacactaactacatttcaactggtcaatagccacatgtggccagtggctactgtgaaggagaaggcaaccctaagacatgaactgggtcttgagtagggagagttagaaagaaacaagaggaccctattcttattaggtactcacttgtttcttcactttcttcagatctctgcaaaatgataccttaccagaaagatcactgatggaaaattgcagctccccaccatcattctgtatctttttatccttataaaaagtttcttcatgacacttataattgcctagtttgtctatcatcaagtttttttttgttttttttttaactagaattgaagagtatgagagctggtatactgctgtgctcacagctttatccctgcacccagaaaagtgcctggcacacattaggggcttaggatgaacctgtcattctgtgggagaggcagaacacttacaaggccttctcaaggccttatacaactctatagggcagagctgggcttcctggggtgagaaccgacatgctctgctgtgtggttccatcttctcaccctgcagccttgcagcagatggagagcacatgctattcctcaactgtttgagaatggtagatttccctttatgaagcttgttccaaaattgttctggagacatacaattactgttattcaatacttgccaatagatactgaattctttcaatctgttcagtagaattcttcattacaggtctttgatgtctggacaatctcatttcaaaatgagatatagcagataatgagaatttcttgaatattttctggctgcatgaagtgctcattttattaaccctcattgatggagggcatggagccagagagagctggctttttaaaaaggcattgtcttttgtgaataaattatgtgcatattttaaaatcaaggcattttatttaggaatgtttgattgcctggagcaagattttattactatgtaacatctgtaacaatgtgttaaaatgctgtgtaaaatattgctaaaggataggatcgctactcaaattagcattctaagtaaaagctctcataagttttaagaaattaatgggggaatctcttttcaggttatcatagtgacctgaatgggaagattttcaaaaatctttacactccatattcttgctttactgcatatggaaaatccaggggtattgtaagaagagattctttgaagcattcattttgaggaacagttcatgaaatggctgacaagagacgttgtgtatgtttggtgaagaatggtgtagtcacacagaaacagataattagtttgggacaaaagaaagaggctaggaagcatagataagaagaaagaaagtaagtaattctatcataagggaaagggatatttcaggcaggaaaaaacagttgtaaaggccatgagctaaggatgaaacaccatcaaaggaggcagaagagcccacagaaacatttccgaggatatgaatttaagaataagagacatttgccagtgatcaaggagaaagctctaattctcatgacatcgttgtgcatggatgggatgttggaaaccatataggtcaagctcttcttttacaaataggaaacaaagacctagtgggattgccagaagttacacagaggaaaaaggcttccctactctcctgactctatatccgttctcttctacaaactttttacatgctatgaatacttttacaaaagtacacgctttctgagtatgaatgtaatatatgttcactgaacaaaatttgaaaaatatagaaacagaaacataaaataatcctaaaataattaacatttttgcttactttcacttagtctgttacttattcaaacatgtgtgttttaaatcatggtcattctatatgactgttttttaattgtcgttttcacttactatgtcatgttgcttaggaccacaaagtttgcaaatccataataacatgagacaaaaaaagaagtctgattaggtaatttcagggaaccccttgtgactttctgtgtattttttcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtggtatgtaatttacaaagttataggaaacacttttaaattatggttactagtgatgtatgggaccaaatcctgccttatggatgaagtgtttgagtttgaccatatcaacactgaattcctactaatcattgtagagagggatacaatttaaggttagttttctggttgtgggtattgttcttttttaaaaaaatataaaaccaaaattgtcctttaaaaagtcattctttctgagtttcagtacattcgttggccacattgtgggtgcattacattgttagaaagataaaattaaccaaataggatcaaaatgtggtttccaggtttaggcacaatggaagtagtaagtagggaacaagtctgtgtaaaacagtcggacttatgaaaaagtagatctgagttgtggagtgatataggttgggcttcctgtaaatagactctgagattgagagttgtggacagaaggattttggggagatacatctatgaggatgtgaggaaggtgaggatgtgcagagggagaagttgatccacaggcaattgcaactgaggttgattgcaactgagttcaggagatgagctggtccttaggagttgttcccagtttagagctaagctattgatatccccattttagcagtccttggctttaggccaccctcagggttgggtataaccttgagtgagacagtttgctgtaggaaagggtgattcccaatgaggagcacagaacctgttgttcctagcagccgagggatgggtacatcagccccaagaagggatctgggcagacgacgagattatctattactggagaatagtataaagttggagctgaggttcaagaatggaataagaatgagccaaataagtacatgattaacaacaagagggatcagagagccttttgttcctagctggaagatgggttgtcttcttggcttgcctttggtttcatagattagtctgtgtatatggcccaaatgcttctctgaagagttcttttaaaggaactctcatggaactgtctcaaaaaaaggacaggtatatatcatggttcatcatttctaggtttctgtattatttcaaacgtgattggagcttctgtatattaagaatgttatagcaaattctattgcatttaatatttactttaggtaagctaccagaactgtaagttgtgtctgtcaggttctatatgttctgatttgtgtttctccagttatcatttcttatataaacatgattacaattatttctaatttaaatatataatggtaccttaaacatagactatagtttggaagaattaattatttcattcagggagctagtatatcttttttctgtaaagggccagatagtaaatattttaggctttgtgagccatttggtctctttcactactgctttgcctttgtagtagaattgtgctaggcaatataagcaatattagcagacaatataggcagcgatagacaatatgcaattgaatgagcttggttgtgttccagtaaaacttgatttgtgacaaatgggtttggccattgggcagtagttttctgacctctgattttattaataaagctcttgaatttatttttttaacttttattttaagttcaggggtacctatgcaagtttgttacataggtaaactggtgtcatggggttttgttctacagatcatttcatcatccaggtcttaagcctagtacccatcagttatttttcctgatcctctcccttcttccaccttccacccttgaataagccccagtgtgtgttgtttccctctatgcgtccatgtgttctcaacatttagctcccacttataagtgagaacatgtggtatttggttttctgttcctgtgttagtttgctaaggataatggcctccagctccatccatgtccctgcaaaagacatgatctcatttttcttttatggctgcatacctaaagaaagaaataccattcaatacagcaatcccattactgggtatatactgaaagttatataaatcattctatgataaatacacatgcatatgtatgttcattgcaacactcttcgcaatagcaaagacatggaatcaacctaaatgtccatcaatgatagactgaatagagcttttgaatttatattctccattgccttttccaggtggaaaaacgaatgtcagcaaaggtagatacatcagcctataatgctagtttgagtaattataaatagtttgtagctgcattgctggagagtggtgtgtgaggtgggaatcagtgaaaaatggcattcaagaagtcctatcagcaaggtcttccatgctttttagcaaatttggatttgactctttagacaggagagacataaaaggagaagagagttgctatgatttgtatctctccctatctttctctctccacctgtgttttagttgattcattgcttagtgatacatctgttcagagttagtcaaaggaaataatccgggcaaaagttttgcagagaaaaatctttaagctagtatgccaccttattttacttttatggatctttgtatatggtatctagaacttagattcccagagagactgtatactttatcttagaatggaattcagtctccagtatttgacaatttggctgcatttttttttattagcttaaagtttataaatggtttgctcttcctttttcctaacaatcttccattaatatgaaagacatctgatttgtagaatcatattattatgttgcttaaatatctcttgctatttaagttataggtttaataaaagaaaatcaatttttaaaatattcttactacatagtgacaattacaaaataaataacatcttctttctttaaaattctagattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaaggtaaatattgttaaatatctttcaagttttaatgagaagcttcattggataatttaattctaatatttataaggaatgtaaatttctctttttatatgactttttcagtttggcaggtcatactcaatcctttttgtttattgttgttaaatctggtaatcatgtgaaattacctagcagtaatgttataggaaatgtgtcttttaaaagatacattatattagaaatattaatattttagttgtgagtacagtagaggtgactgttttttattttactttatctttttcatcattcatctgttctctttcttcactcagctatattttctatagattttcactagttacagagaacaatgagcaacacaatgaaatgtgtacatggcactaaaggtattaattgtttaatccaaaatagtaattagaataattttatcctgtgaagtgtacagtggtcaatttctcttttgagtactaaaatcatcacccaaataattattcatattagctgctggtgaaggttctaagattttcacgtaataacatggacatccagctttcaagtacctttcatttgaatagtcaatgggaaaaatacaacatgtggttatgttcctgggtctttaatatggcaaattaagtttttaaaatctaaacaatgaaataaaagttaggtgctgtgaaatactttgagcctcctgataggcacgtcactgtaagaacaaaatcactcttaatgattagtcattaaatgactttgtatatataatttttcattttttgaagaatcttttgagcctttataattatcatctctgttcaacctgcatatctgtacttccctaagactttgcagcaatttctgttaaagtgtatgacatgtgcaacataggagggtgctttagagaatcagaagtgggggattagaactgggatataatgctaggagtggatggtgattctctgcccaactttggggaccaggaagaccaagcccagaatgatccttgggagtatacattgtctttgttttacttctttttccttaactgtctacaagggatagagtagagtgttccactctaggtccttgtaacagcattgacagcaaatagaaaagactatttactcgtggcatgtttctctcacagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggtaagtcaaggctgcaaagaatgtgatctaaaatagaggaaaattctcttaagtaaaattgtgatgctcttgtaagtaaaaatcttttttttaataaaaggattcttttaaacataaaaatgtaagtattctactgttgccacccacctaagtatttaataatgaataatattttataactggctggcaaaaatgatgtctattacttgtatttattcttgaactggaatattgtttgaatgaattttgaagcactgaatttagattaattatatctgattggatccactgtaattttgttttgtcagtttttaaactaatgacaacaagtgaaatgcccaaatcaatctggttatttttattattcatttaataggacagtattttcctttcatgatatgattacttgaatcaagattagtcttcagatggtttagatctggttttagctatctgtatttatccatgtatgtatggagagagagagaagaacagagaaagagagggggagaatatgtgactatatcagtaatgatgcacaagaaattttaatagtggattagtgttaataatattataaaataataacaaaatgttgttttatattatataaatagtattaatcttatatattatataccatagaatatattatatgttattaaataaatatgatattatataatgttagtgttactaatagtggtattagtggttttaggtaatagtatctcctgaagagtataatttgggaaagatataagggatgggatagaaatgagggttttccccccctttttagagtattttttatctctggaaatttttcattatgcaaaaacaaagtaagaaatttttaaaaattaaatataggcttatatctagattttcaagtctagagcttttgctttaaaaatgtatgtagcatttaccagtgtttcctaaattttcttttgggatattaaatatgtaaaacatacaatagaatatggtcaaaatttcaggatagatttttaaaaattattttatttgctaatgagtgtgaagattccattgaaacatcaccagtgagctagaatattctatagattctgaagtggtcagtgggaatgtattaaaatataacaagaatcttttttatgtttgacagagctgcccattcctgtgaacaaagtcaattatttccttactgaaaaatatcaagtattcaatgcaagttaaatgtcttaaaaaaaaatgaaacaccatctttttcccccatcccccaggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagagtgagatgaactttcatttgtttacagtcatacagaggcctctccctgctgatttggccagtgttttatgtttagctttgcctgtatttatttttaaatagataaataaccaaatttgtcttataaactaattcttaggtctctttgggctagaccaaaggattcaacaagtttactttcattaaatataagagttcagaagaccttttatgcatacttatatctgactattaatttctactttaaagggtgaaatatagaaagttaagtagaaacaataactttagaaagatgacttatgagagttaccattttatcttgcctttcaattatattctttacttaaagggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggtatgccagtcattaacatattagcctttttgagttgtgcttcagacattttgtaggcatccatcaaatgaatgtacattggtgattgctaaatgcattatactctaaatgtttctatgttaagtcaaacaaatattattaattgaaatacaatttattaatgggcataggaagagacttataaagatacaacaatcttacccttttctgaacccccgccccagttttatttaaaataaatagaagttacaaaacaggataataattgacttagaagtgcctaacaatgtatagaaaactgtctgatgaactagactcttcctgtggactttagtttcttttatcttttattttgtttcttaatgccagtaaatatagatatttatttagaatttgcactaaaagtgtggacagtttttacttaatatctaaaatgccctttataattaaaaaaattgactaaaataagagaaaatgaacaaaatagttaaaacttgaaaaattgaaaaacaatattctagatttaggctaaccagtcttaaatattataaaacattccccaagaattacaaattttgtaaacttggcattttgtaatatgtaagaataagatgttttcataccatttttttatcagtaagtggaaaaggcatatgaacaaccatgaaaatgttagtaactttaactagcacctctatctacaggtagccttattttggctagacaaattaccagagtatgcgtcaacttatttgttgctcatggggggcggtagtaaatgctgttaaaaggtaagcatacagatgtagattttcctacacagaaaaacccattattgttaatatttttgaaatcctgagcttttaaagcagatttagaacttgaaacatttcctaagtaaaaagagtggaatgcaatcccagcactttgggaggccgaggcgggtggatcacgaggtcaggagatggagaccatcctggctaacacagtgaaaccccgtctgtactagaaatacaaaaaaattagccgggcgtggtggcgggcacctgtagtcccagctattccggcgactgaggcaggagaatggcgtgaacctgggaggcggagcttgcagtgagccgagattgcaccactgcactccagcctgggcaacaaagcgagactccatctcaaaaaaaacaaaaaacaaaaaaccggaatgcaagtcaatgagattcttatgttaaaagcagaaacaaatacattgattattcattgaagcagcctttcaactttaatgacattatcagcactttatctgtgcatgaggttcaagttccatcattaaccagcatccataggatcctacttattcttaaaattcacatcctctagggaagggactctgtattctacagcacagatttgaggtgcaggcaatttaattaccttctatttgagcatttgattttattcatgtttctatctgtctgagtgtgatatccaggtttttcacttttctctgttgttaaattaaagattttaggtagatttaatttcattttctgataaatgtctgtcagaaacattggaatatttttatgaccaatagtgaaactgcaagctggatcaagttttatttatttatcagtttataaaaacttttaacatagactcagaaaattgaactaaatcctgattataaacatccaggaatagcaaatttgggttttctttctgcctttctttttgactacgttgcaagaacaatatttgaaaccaatgggatttattttaattgtagaagactggtaatttttatgtaagtttcatatcatgtaatattaataccaagcatactgcattttatgtttgtgcaatggtgttagaacctgcatgacattaaaaaaattttaagaataaggatttattgtttttaatctgtaaataatactcttatcacatcaataatgttttatcttgaaaataatagactgtaaatttctgactttgaaataccataaatatacacaactttaaaatgccataaatatacatgccataaatatacacaactttaaaagtattacaaatataatacgcaaaaagaactactttttagtaccatgtttctgagatttttggtttcaactaaaaaattaaaatatatgtcagcaaaaactgtgattacattatttctttcctcatttcctatcttcctccttcttttcctccctctctttctcccttccttcctttctttcataggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaagttaaacatatcaggggaaagccttgtttcaggctagcgtttcatgtaattttgagtagaaagtgtctcacatttttgttttggaagtcttggccaggcatggtggctcatgccagtaatcccagcactttgggaggccgcagcgggcagatcacgaggtcaggagattgacaccatcctggccaatatggttgaattcccgtctctactgaaagtacaaaaattagctgggcgtggtggcacatgcctgtattcccagatacttgggaggctgaggcaggagactcgcttgaacccaggaggcagaggttgcagtgagctgagatcacgccattgcactccagcctggcgacatagagagactccatctcaaaaaaaaaaaaaaaaaaaaaaaaaaaaaggccgggcgcagtggctcatgcctgtaatcccagcactttgggaggccgaggcgggcggatcacgaggtcatgagtttgagaccagcttggccaatatggtgaaaccccgtctctactaaaaaaaatacaaaaattagccaggtgtggtggcgcatgcttgtagtcccagctgcttgagagcctgaggcaggagaatcacttgaacctgggaggcggaggttgcagtgagccgagatcacgccactgcgctccagcctgggcaacagagtgagacttcgtctcaaaaaaaaaaaaaaaaaaggaaagaaagtcttcattacccttcatgtatgagtctcttctcaaggatcttttgagtggtctattgaattaagggccaatcctccagcctgtgcacacagtttgatagtaatgtgagctcttaatatcaggaaattacaaaggggaacagattcctatttattggctgtagtagatcaagatgtacttttcatccataccacctattctctgcctgctttactgccagaccaccaatctggtcacaggcaggattctgtcatgggtctgggtgttacatcccacaatgggtttatctggtgagggatttatattacccactgttatgctagtctgttgtgacttatgtagaaaaaaacaccacagtcaccccccacccagctcatgtatttctctatatttcttctctcttacttctcattggctgtttacttccaagacttgaaagaaggaacccaattattattgattcagccacaaagagagagagagaaaaaaaggctaattaatcatgaaaactaagtatttgtgcagccatatttggtacctagtactaaattatcactacatcttaagtataaaacactataaattccatcataattgttattacatgataactatgacataatattatgaccttacctttcaaaagaaattccaaggtatgaattagccataaaaatatttagataatccccatatactcagcaacttttccggccccatatgtcaccattcccttcatttaatcacttataggttgtcagtaattcacatagatcacttttaattaataaaccaattgctgaaatgcccattgtctactgtcctgtggatggaaggctagactgacagcttgcctgcaagggctggacttcctgatgctccaaaattgaaatataacaaataaggatttggctattgaatttcaatttcataagaaaatgggacctgtaagagggagagaacaaactttcactgtagcccaatgagctcgtccttggaaaaaaaatgggcagctgtgtttgtaaggagtgttggattggcaaaagagtaactgtgaatatctctcaagcagcagaaaattacacatgaatatgtaatttattttttataaaatgtctcttagcttataagtttagattacaagttcagcatttagtattcaaatcttcaattgatgaaacttcacaataacgtttttcatcaaacttctggacttgggcactggacagtgtgtttataatctacttttactgttagagaaaatgaagacctacactagtattcataaataatttttgttcattttattgtaactgcggtcataaactctagtgttttaaacctagtgttaagcacacttgttctgggaaataatatcgttacagctacaaattttcaatttgtcttagagtctaaagggaagatttaggttacccaattcctactgtattgttgaatatgtaaagcatgcgtgcttgagctttaattcattagatgtccatggctattttgattgttgatgataatagtagctgcatgatgctcagccctttgtgacttttttccttgcttatatcctgtctttcctatcacaaaagtttcttggtaacatgaagtttatcttttaaccttaataagatatacaatattgtgcacacaataaacattctgttagcattattcggtgacacagattagattcacagctgaggtacattgagaaaagactgttagtataaatccatcaaaattaacaagctgttcacaagggcaatgtggttaagtataccaaagccctgagaatagcagagacccatggaaatctacttgtgaaacctaaactaaaatgttacatctatggaatcaaagaagacttatataatggattttctctatttttttcttactaaatttcactggtccctgaggagtggtatgaacagtttggagtcaaaataccctaattagactccaggctcctcatctccagatatatgtatatatctggccctcagatttctatgagtttctatgaggcttaaataagataaggtatatgtaagaactgacacacaatagaagctcatttcagtttgttttaaatctgtgctgttgacatcaatgcaaatctcatgaagaaaacaaaacaagattgtattgcatgttaagcttctatccgtgttgaaagtggaaagcattgtgttatattttctgtttgtatagcggatggatgatataggttcaatgagaactttgcttcacagagtcaacatatgtacttcacttatactagatctgttaataaggacttgtatgcaaaataaatagttctggtaaatcaatgtattgaatctcctctctttatctcagattaataaaaaccacttttaaattttgactcgctaaagtaggtacaccataattcagaggacagtttaggtctgtattatgtgaggagcctgattgtagtaacaaagatcccgccaagtctcagtttcttcatatggtaaatgtgcatttcttcttcacgcaggaatcctgcaccagcgtgcccagttggctgatgcttatggacacctcttattcagctggcagctctcaggccctagactctgtccatcttggggttatgtcctcttctaggtcctgggcctcctctctattcacctgccaaatggaaaagtagaggatgtggggtcttgtgtgggtgtttatggcaagagtattagcagcataaatcatttctgcctctattctctgggtcagaattcagtcacatgctctacctaattgcaagagaagacaggaaatgccaactagttgagcatctaggaatagaaagtgggatttggtaaaaaaaatttttctgccacatgataattacatgtaacattctaaattataaaactgcagtcattgtaaacagaaataagattctacttgtttatcctgctctttttgtttttttttttgtttggccttactgaattttcttctttcaggtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgaggtatagtcagcattagcactcctgtaatttttccccaatttgtctttgattttctttttcctttttattgtaaattcagggagcacatgtgcaggtttgttacatgggtatattgcataatgctggggtttgggcttctagtgagcccataacccaaatagtgaatatagtacccaataggtagtttttcaacccacaccccactcctaccctgctgcctcaagtagtccccagtgtctgttgtttccatctttatgtccatgtgtatccattgtctggctcctacttataagtgagaacacatggtatttgattttctgtttctgcattaattcacttaggataatggctcctaattgcatctatgttgcttcaaaggacatgatttaattattttatatgactgtgtagtattccatggtgtatatctataacattttctttatccagttcactgttgatggacactaaagttgattccatacccttcctattgggaataggttgactgatgtctgatgttgagtggaagcacctgccctggtgtgggctgcagggagggaaggatggtaaaaagcgatcatgttggaatgtattggggtctcttggggagtgataagggggtgtaccaacttctagtcctgagccagcaggaatgaagtttgcttccctctcgtgcccgtgttgcaggactcatgactcaattcataaagactttgtcctttggctctgcagtgcagctgcaggccacagatatgcccctctaggagctgttaccaaaatgggctcagggcaaggcctcttccccaactccagggcaagcaacttcacaacttgtctgtccgccattgctgggacactgctgctctgtctaaaggcggggagttgggccctgttcttcctgtaagcccaagtggcacaagcttactttcagcagggattgagccactgaaaaaagcacacacaaaaaatgctttctttgtgtgtatgcactaagtaccagtgggaagaaccacagctgtgtctgcaacagtctagagtgggagatgactccctctctacgactgtccctaggcattggtgctgcccccttcagtgactggccccatgcctgcatttcctttgtcccaaggggactttgatgggctgtgctccccctcccttatgggcagcctacactgtgggtttagatcttcagaagtcctttagccccctgggacccacctgtcccccatgcttcccaacgtcagagccagttgtggggtatatttgcaggagatctggtggtacagtgactctagagcagagagatctcaggcagggcagtggcactatgggtacacaaccagtatggcaccctccatctcattttgggtctgagggaaacataggtgtgcctgcacaagctagcaacctggttctctgtccctgggaagttcctgaatagccacttatagcattgtcttgggtcactagcacagaggggctccttagaagcttggcagtcaggagattgtcagaggagtgaggggaggagagaagcactcccacctactttccatggggctccaagctccttgggggtcaatctctgtggactcttgctgcttcccttttctacaccctgcttcttcccactggccctctgacagatcctggctctcttcccccagttttctgttcagaactgggcctttcaccagtaactttgatcatcttcctgaggagaactggcacctgatgtccctagagagccatctgctcgaggcactgggcactgtgcactgtgctgtcactgctgaggggaatggtgactgtagtcaccctgtgtggccacacctcgagagctgtctttgattttcttttgcatagtattacttgtaaattcatgtgataatatttactatgtctgggatttttttggaaatccatatgcatgatggggggaaaaatcacagaccacacacacacacacacacacacacacacacacacacacacaaactctagatatctgaaatcaaattttttttgaagtttttattgctacataattgatatacgtattttcagagtacatgtgataatttgatgcattcatataatcaaatcagagtaattgagatatccatcaccttaaatattttttctttatggtaggaacagtctaattattctgcagctgttttgaaatgtacaatagattattgttacctatgtcaaattctttttttttgtttgtttgtttttggagacaaggggtcttattctgtcacccaggcagtaatgcagtgatgcgatcatagctcactgaagcttcgacctcccggctcaagcaacatttccaccttagcctcatgagtaactgggactacaggcatgtgccaccatgcctggctgtttttttttttaattttttaaaaatttattttattttattttaattaattagttttttgagacagagtcttgctctgtcacccaggctggagtgcagtggcgcgatctctgctcactgcaagctccacctcccgggtttacgccattctcctgcctcagcctcccgagtagctgggactacaggcgcccgccaccacacctggctaattttttgtattttttagtgagacagggtttcactgtgttagccaggatggtcttgatctcctgacctcatgatccgcccgccttggcctcccaaagtgctgggattacaggcgtgagccactgtgtctgatctatagtcaaatttttaagttcagattctgcccctgttttcccatcaaaactacccctctctcacatttttcctcttctgattgaaggcaaagccaatcaaccacgctggatgtctggatatcatccccagctgcaccctttctgtaatcgttacatgtatttggttaccaagtctagtcagttttccctttaagtgtgctttctgactattctgactgtggagaacttctatactgactcaaaatactgatggtgtaacataataagacaatgtcaaacttacaaaaacttgtagtttttaacatccatgtacactttgaaaaaaaattaaggaagtatttcagccaatcaaaaaactgaaacacaataagtagtttgagaataacaagcatattacagtccatctttatgtgtctcagcctcccacagtgataagaagtgaaggcgcaaggtcctatctactttgaagggggaacataatcttttggcccatggagttggtttctgtaacttgtaagaatgactccccttttcaaagtttggtcggacatttacagatctgtttctttatgtcttcatcagcatgagcctgagaaccttggctggagtatcaaccaacccactgtaggatgcgatttttctggttgcctgtgtgcactcaagtttcttcctcctctttcccttctttggctagttttaataatcaaaagaaggtggggaagcagcatatggggcccagttaagctgagcacagagttgtttttaatgaataattccaacctaaccacaggacagtggtatttaccagtcaaactcctaagtctttttctggaagggaggatggggaggtggaagagacaatctgattataaaatatacatggaaatacaaaatgccaagaatagccagcaactcacaaagaagaatatggagggtggccctacttagccaatgtgtcagataatacacagttaaagtaaataaggcagtgtgatatttgctctgggatgaacaaacaggccagagagaagaaaatagtccagatttgtcagtcgttttatagtttttgcttttagaatcatgtttgattctaaacagctttcttaatacctaaacagctttcttaaattaataaagatgaaaccagaatgcaattaattaaaaaacaaaaataccaataaaacctgattcataaattaaaaaacttagaaaataagaattgacgagaaggaaataattattaaaagagaaaatattgaaaattgtaagagactatataaatgtcgacaaataaattttaaaaacctatgtgaaattggctctagcagatatacagcagatatagaaagtctaaacctatgcacttttgaaaatgaatggagaataaacattaaaaacattaaaagctcagtaggtggttttccaaaggaattccaccaaatatgtttacatggtccatgtcttactttttttttttttttcagtctaatgactcttcttcagagccttcaacatgagatagcacagaaacgaataccttttttcccttcggtattgcaatatgtgattaaggaagtcatcagtgatgccctctggcagtctatttgccatgcacatgttctgccatcattcttgaggtgtgattaccctaatggtattaaatctcaatcaagatgttgcaggaatatcatccgtttacttctcagcttctgacacatgatgactcatgaaacatctaggttgtgtgccctagccatgatctgaaaacctctcacctgaggagcatttagaatttagaaattagtttcaaatgtctataaagattttcctcagtaataagaagcaataatttcccagttaccagattcttactgctagatacacttcccaggtgattaaaaaggttttcttgttttgagcataaaatctacattaaaatggcaaatagtctgatcttttcttccagcgaataagttcatccatttttagagtactgcattaggaggcatggggttgtttctagattccactctctccatctgcttgtttggtcatcagcctggtacatttcatgtacaactgtgtaacggctccattgtttttatatgtctagttctgaatatatacaaagatctatgtctcccacgggttctaatttggttttgaggatgtctttcatcatctctcagttctacttatggctagtggtatccactccatcaataatgcccaggtggaaatcgttctcatagcaacttagtattcacattggcaataaggaaacctagtctacagaagctgttatacctacggtacatcccaggttgtaccaatacttactgtataatagtttcctggactttctcaaaatgtagcagtgactgtggagtcaccattgcccatcttacagggaaattctcacaataattctgttcagtcctaccttggtaacagggcaaagtccttctttcctatttctactttatgcaggacaactaagctccatactttgtttatagaaacatacaactctccggaactgatgaatggtctataggtgatgagtcagggggatattgcactttaccttccttggggagaaaattatgaggtggagattcgtgtccagaggctttttaggaagtgctcttgaggtcaacacctgtgtaagtgaaagaagcaagattgggcagggatgaaggcaaagcatgaggcagttgaaactgatgctacagtatactacagtttgttttgaaatgggactgacccttcagagctgtctgagttagaatgatggtgagttttataatcttgtgttgagcagtcattgtgtatggaccatgccaggaagagcatttgaccatgtgagaaggggttgtcttcagatgagacaatttgcaaaggagcctgtcagatgagggtaataagtcctttccagaaggggaatcttagtgaacatcagagcatccaccactgagatgcagggtacagccacgttcaagagaagtttgttctgaaaagctctccctctctttcccttggtcttttatgatataccttattttttcactgcccactttgactctttgccttctacccattcctgtttccttcctgccccatccactgttgttggtcccaagagtactccctattatgtctttcctctcttgtctttctcttagcagagtaacttctagaaactttgttaagtatcactgtaggctggtaaaaataaaatggtcctgggaagataagaggaaagaaatatacagagaacaactatgccaatactttgagagagaatcatgatgcatatcatttttatctctaccttttcctctgcattctaaaacaacttgaatttgtcctatgcatcactgattaaattttctgcagtttgaattctgtattttattgtttctcatgaacattgtagttttgcaattgcattttttctttgagatttttattattaaatagtattattttaatctcttcactcaagcttttgtttcttcatagttgcttattgttatttttaaaatatatacatttaaaaaattttgtaagggcttctaggaaaatatgtgctccctgcctgagacctcattagatgtacttatgaaaaatctgtaattctgggatgcagtgcatcattcccattccttttactctctacatattacgaattggaaactcagaattgatataaagatgaaagagctgataacagtgggaacactaaagctctgaggtaggtggcagccagttattcttggttagtgtagtctctgtggcctggagttcaaagaagtcaggaaatgggtcttacccccagtattagtttgttctcacactgctaataaagacatactcaagactgggtaatttataaaggaaaggaggtttaatggactcacagttccacatggctggagaggcctcacaattatggcagaagatgaaggaggagcaaaggcatgtcttacatggccacaggcaagagagcgtgtgtaggggaatggtcctttataaaaccatcaaatcttgtgagtcttactcattatcatgagaacaccactggaaaaaacccacccccatgattcaacacctcccgccaggtccctcccatgacgtggggattatgggagctacaattcaagatgagatttgggtggggacacagccaaaccttaacacccactttgtggtacttcttgttatttaggttcatggcgtggaatgtgtatcctctagtctactccaaactgattccttcattagtgaaattttacctgtattttagaaagattttaatctttagtttctttctttctgttagtcttggccctttatggtgtctacatgtgcatttgaagaaggcacaactcatgcaaccagtctctgccagtttaactcagaagtctctttcctacatctttgttttaatttgctgtaaaaatatatgtgctcatggaaaacaaacaaacaaacaaacaaacaaaaacaaaaaaacctcagtcagtacagaaggatgtagaaaaatgagtaaaattcccctgactccttctgaatcttatattcctacttcccagaggtaaccgctattgacagttttttatataccctttgaaaaatttttatgcgtatccaaacatatgtgtcttattcttacacaaatggaattttacactgcaatctgttcagtaacttgctctttttactttataatctatcttaaacatttctttttcatactagctaaaatccattgcactaaaaaaattggttacatatttttcattgcatagattccccttagtatttgatactattgacatttcttcatgagcactgttttactgtggtgtttatagttctcttacattttttatatctttctgggattcacatttcttgtttagtatttagttctgtctagttctcctttcccaaatgtttatatacttttgcagacttccatcacctatatttgtattattttcctctcctttactatcttcgcaatcttggttctcttgagatatgggaagtagccactgaaaagtaaaaaggatatagattttatagccagctagaccttaatccaaatcttcactctactgtttaatgccatgtgactttaggaaaattaatttctctcacatttgggttctttgttgcaaaatgaggataataaggcttaatctaaacaaaggctctgagtattgcatgaaataatgtttgtgaagaaactaaccaatttacagacatttagaaagtgttttatacaacaactgtaatttagaaacattttaatgaaatagcaggttgctacctcaacttaatatctacatcataggataaaaattaaaggctttaaatttttaaaattcaacaccttttctacatcatagaataaaaaattaaaggttttaaattttttaaaaacaggaaaaatttatatttctattttcctgagatagcctatatatagtaccatttctcaaactgttgctctgcactgctattcagcagaatagaaataattgttctgaattttaaagaaagaaagggattccaggttcacatggacttgggaaaaccttgattgagctaagtaggctctttctatgcaggattatttttagacactttaatatactgaattccattttgaatctctaatattcggaatttattcccctatgaaacttccccatcacctttttatcccagaacatttattactatctttcgtaaccattggctgggattttccacctgtaatcacccttttcccccctcttactggttgtagatttctttgagaaatgaagagcatatgatatgaagagctgccttacatatacagtagataaggtggaaggcaatataaacatataaaatatagttgattctcatgattcacagtagccaatccttatcattcacaatcccctacttgtgaatttccctactcactaaggtgtatttgcaacctccaaagtcgatacttctggtgttttcatggtcattcagggacatacagaaagtgttggagaatttgattcacctgatttgtgcatttccagccgaggttgaagaagccaacaccttgactttgtttcagctctcatgttgtaaacaaatgttctttttccagtccatttattatcacttttttaaatttttgtgctttctgttggtgagttttctgtttaaatttgcccccaagtatagtgctgaaatatggcgttcctaagcacaagaaggctgtgatgtaccctaagtagaaaatatgtatgttagatgaactttattcaggtgtgagtcatagtgcttattaaacatgagaaatgtatttgaatgattctaagtttttgccaatatgtacatgtctgcaaattaccacaaaagtgctcaatattgattttggggttacaaagttggatgagtagacaaatgtgcaaataaggaatccaagaatagaggaaccaactgtatataaaatcagtagcaccttggagaaattactgtacatataaagaagtatgtaaagatgtttatggcaatattatttgtaatagtaaatagccattgtcagataaatcttgcaaatagtataaaggcaaacaatggaatccccacagcaatgaaaataatacattgagtctgatagcggtggctcatgcctgtaatcccagcattttgggaagccagagcctggtggatcatttgaggacaggagtttgagaccagcctggccaacatggcaaacccccgtctctactaaaaacacaaaaattagctgagcatggttaacgcacacctgtaatcctagctattcgggagactgaggcaggagaatagtttgaacctgggaggcagaggttgcagtgagctgagatcgtaccactgcactccagcctgggtgacagagtgagaccctgtctcaaaaaaaaaaaaaaaatacattgagtctacataagaaaacatgggtaacctcaacagtgtgcattgaaggaaaaattaaggagacacagtgcattttagagtgaataatatgatgggaagagttttgcaaagggagatcgaaatgggctaataaatgggtcaaaaagaataaattataataaaagaccatttgttgtccagtagaaacaatgctgttgaccgaagtaggaccaattcaaactatgcacctgagatccaagaaaaaaaataagaaaaaataaaatcattaacattcttatgagttaccagtaatgagaaacaatgtactatgagaaagaagtataaaatacctaggaatagattcagcaagaaacaagtggaactgatatgagtaaagataaaaacaaaatcttaaaggtgaaggtaaaagaaaactgaaacatgcatataaaagaccaaggtcttagacagaaaaactacattttcttgtgaattaggccctttactgctgcctttagatatttttgttaactagaagctgccattactaatttaacatcagcaaaatataccatgaattggatatccagtgttgatgaacaacggctggcatctcagggctgtggttgcccctacaactgtgatctaatgtcattcacactttgttttctcctttgaatggagctgtttcttataaagtctatgacctttgtctgtttacatcattgtgtgatcatttggctttctttaaagattggattttcaacggttaacatttttcagtaaatttaggggttgtattcttttcccattttccccataaagaacctaagtggaatttgtattcagaactgatttttgtggagtaattctttctagctgcaactcgtaattctagtgacaaaaaagacacccttaaaaatgattatggacataaacgttattctgctaatgacaacattcaaactttggctttggtcaatctggaaaatgcactgtttctgtcattggatgtagactgagtcccagaagaccattgtgttgcacacacttcaagacacagtgttggaggaggacaggcgtttcaccattcagctgatatcaattgatgaggtagaaatatctccagtaaaaggtaagagaaattcacatttttggaaattaaaaagtaaattctcagaaaaaatgtaataaaaataacccgtagttacaaaaatggacagggttaggtttcataattcctaaaacataaagataccattttccacatgtattaaaggttaagaattttttaaattaaaattataatacccaatcttggtaaggtcataggtcaaagatttcatacagcttagctgtgtaatttttttctaatgaagatgtttattgtagcagtgtttataaaatgtaaaataaaatatgtcagcttcctaaatggtccaacagtaggagactagttaaatgtgtcagaatactaggcagccattcaacgtgacataacaggaaaaactctcaattacattaaaaattaagaacacataattacatggataattgtcacgttaagaaaacaggttttgcaacaacatgctaaatgtaatctgttttgtcatgtgcatgtcttacatgaggttggaattatttatttgaaatgttaatagtggtttttgattacctatattttctaaacatatttacaattatcacactttacctttgtaataaaacattatttttaaatgtgtcatattatgtttagcattatagcctatgtacgtctgttttcatctgaaagtagttactcaaatattttgacacttcagaaacaggcattttaattctcatttgcctccagttgatatgatgatttgttttttggatccatagagaaaagagtaatgattctaaaatggttttattgtgctataaacaataataaccaaccataaaaaactggttcagaaacttttagcatgaaaatttggtgattaatacatttcttttttgccatcaagaactccatcctatgtgactaaaagcagatttaatgtccaaggaaatttttagaattgtagagtatctatcactgtgtatacttagggtagttataatttctgcattttatttaggatattttccattaagggaatgacatcactgcaccatattcttttataagtctttagttagctttagttaactctttcataagtctttagttatctacatcatgttaaaatgacagatgtcacataggctaattaaacatagaagaatatatgattggatcaggataaatcatttaccatatcaaaaaaatttttttgaggcagggtcttgctctgtcacccaggctgcagtgcagtggtgtgatcacagattcctgcagccttgaattcccaggctcaaacaaacctcccacctcagcctcctgagtagctaggactacaggcatgtggcactatgcccagttaatttatttttatgtttgcagggatggagtctccctatgttgcccaggctggtcttgaactcctgagctcatgggatcctcccacctcagcctcccaaagtgttgggattacaggtatgatccactgcacctaattcttaatatctttctgtctgactgtgacacttgctgtgacaagccactcttgattccattaatccattgccaaagaaagtgagagtatagtgatacagctctttgtgtcatgaacccctaatatgtgtttctggaaacaattttctttaagtttctgctaagttatatggatactcaaatacttgatatagttttctatttccatcttaatagaaatatttgacacaggtttataaatgcttacagtcaaatgatagagtcagaaaattaaaaatgaaaaagtgcccccaagaaatcttgcttttgccatatagccagttgacatagctatgtagtcaattgcagtgagctgcaaaatggttactgtagaaacaaattaatgccaatggtagaggagcccttgcttttcatgagcatgatagggcaattactgccaatttttttttctgcccctttcattaaaatgtaatcttgggcaagcgatttgcctccatgtcttcaagacctcaatgtgcttcagagtcataggtaaaatgaggatattaataccttactgatatgagagtcatgagaatgaactagattcctgtgtgtaaagtgcttagaaagtttccaggcatatactaagtgcttatgtgcacctgctacaaagtggtctatatcatcttgaatttaggtagtgcatcaataattattcggggtgataagcgagcatcaggagaagttgggatagctccgtcatctaggcacatcctcattggggaaccctcagcaaaatataatggtaccgctattatcaggtaaggacttcatgatttttctttgcctatatgggggttacgaagttttatttaaatcattagtcttaagtttatcattctcaatacatacatagtcttcaagcattaacattctatatactgttaacatcctgtggagaggagaacaaatttggggcagaaattggaataatatcctgacctatcttgatattagatcatgagaaggtttctgactcttgagtgatttgcacaaattacaccaaggaaagcacatggagttgagatcagaaaatctatgttttcacctctgttctgttactaaacatgtgatataagggagttatttcatctctgcaagcttgtgtgtcttagctacaaaatcattccttagaacatcatcagggccaaacattttgctttcaagtgttctaaaatcagagtctgtattagtctgttctcacactgctataaagaactgcttgagactgaataatttatgaagaaaagaggtttaattggttcaaggttctgcaggctgtacaggaagcatggctggggaggcctcaggaaacttacaattatggcagaaggcgaaaggagagctgacgtgtcctacctggctggagcaggtggaaggggtggaggggtgctatgtacttttcaacaaccagatcttgtgagaactctatcaggaaaacagcaagggggaagtccatccccatgattcagtcacctcccaccaggccccacctccaacacttgaggtcacacttcaacatgagatttatgtggggacacagagccaaaccatatcagggcctatcatataactaaattagtatgatcataggcaagtttgtttctggtaaattttcttatgggggatgggaagcaactatcaatggcatagctgggtttgactttatactttatcctcatggtagttatccagaagtaagactatcccttcccatcagcatgcccttatatgaagggtcttccagtctttagagaacttagacttttcatattttgtaccttgcgtgttaagtgaaaagcctataaatattaatacttctttttatttctttaaaccttctgcttttagtaatcagtttttgcttgtattcctgtcaagatagatttacactagcttaatactttgggtgttactatcttggaactttaagacttcctttggtttatagtttggtaaatgaggttatttaaaagaaaactgttattgaaatggatgaaaattgattactgttaaaagacagagaaaatgtttaagaaaagtaccttcaactgaaatgtattggatatacatttgtttattgttgtagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggtatcaatattagctggtttcttttatgccctttactctctgtgctggtgtgtgcacatgtgtgagcatatgtgtatgtgtgggtgtgtttgtgtgtgtgtggttagaagtgggggatggggaggaggtaaatattacagcatttgtggttggcgtgcacgtgtgtgtgtgtgtgtggtgtgtgtgtgtacggttgacaatggagattggggagaaggttaatgtaacagcatttggtattgtggaggtgcctgtgtatgggattaagagtgggaatgaggaggagattaatattacaaaatctgttgttattatttagaggttaggagtttttcttgaaattccacagattctactgttgatgactctttgtctttttctaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggtatagtatgaaatgcttaagattttaatatcatttttatttttagatatgaaaatgttttcttgtttctattccagagttttcataaactgattaatttgctccaaacatcattattttaacatataatctatataattttataaccttatatgtaattttaacacaatcctggtaaatagaacgtttagttacagacagtattgtctggtagattaaacatccaaatcaaataagaaaatgcattttgcataggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaaggtaaaggagaaaggcaattaggaaaaagaaagcaaagagcagagagaaagagagaaagttctattgtgtagagattaatactgagctctaaagcagttctttccctactctttctcagatttgtgtgacattagaacaggacatacaagggaaattatgacaatgactgagtttttttttttaattttgttaaatataacttccctctgaaaattgaaagtatgtgtttctattgtgtggactcactctgggtagccaggaagttgaatatgataacggcttctaattggtgaagacacagcctaacagctctctaaatcagaggtcagctggtgtggctgaatttgcttcttttgatttccatacttgtgaaagggctgaagggagggatttctttcattggtgcatctgaagtctgtatcgtcttctctgtgggtgaatgacatagatgcttgccccatagttttaaagtggggaaaaatttgagtgaaagctagttggccattaatgtgcaccatgttttcaaggaagataatgaattaaccttaatgagtctctttcattccctgatttagtgaggcagatttgatgaggtggaaaaacatctttagcatgtttaagtactcacaggttctgcagctcacaggttgagagagacctaccagcatctctgcccagatagcagataggtgggcccttcaactagagtaatgcctgcatttagaagaatcataaagacatttttcttgtgcatgaaaatatttttgcctttgtaatgtgaatatcatgctttaaaaactttttaaactaaaatatgttactcagtgacttaagtgtatatcatcccatctgggaaaaaaatattgtgggctcacatacccttcaaattttagatttcccaaaaatgcttctatgcctggcaatgagagtgaatttgtactcctagtaaatatagtaaaaagtttgagctgatcactgactattttaattaaataaatgcaatttggtaaaagtagtcgtttagtgtgagatcatatttgtgttactgaccagctagagcttgaggattttgtcttctttgctactgtttttttaaaaagcagtttctatgtaagtttaattctggggaaacaagtttttccttccagataaatttctaggttttctttgatctcaaaaggtaagtagtacaattagctaatctacagcccatctcagactactggtaacagttactcttatcatttaatattctaaatctcaattttctaattttgccttttatataattcgccaactttcaacctttcaactctaggtagggtataaataccagaatagaatttgggaattgaaggaaggactaaaatggtttatcggcattttttagcatgaggaattaaagtcatattttaaagccttggaagttgaagctttgtttgatgggaataatattaatctaaaaaaagacttcttttgcagaagtatcattacagaagtaaactaccatctatattaaggatagaggaattgattatgattggtttctgtagaaattgaaatacttttctttcttttttatttttctttctttctttttctttctttccctttttctttctttccaaagtcttgctgtgtcacccaggacagagtgcagtggcacaatcatagctcactgcaactttgaatgcctggactaaagggatcctctcacctcatacttctaaatagctatgactgcaggcatgtgccatcatgtctggctaattttttaaaattagtttttagtagagacaaggtctcactcactatgttgcccaggttggtattgagagatatttcttttgaatcttgatgatttagtttgaaatttaattagtgtcatgacactcactatttctttgaataaatcatcttaacctaacactgtaaatctcaaggccgcctgcttacttacctatctctgagtgcactaggtctattactgtatatgtatgtattcagccgtgattcccaaaggttcattttatgacagcatctttctgatttcctcacagtttattatcttcccattgcccaagtttagtaactttatattagttttggcttcgtacaggcaccactcattgggagcaacacagaaatctgtttcaaaacatcatttcaggaaaaagagaatattttagcgttgaggatctttaaaagtattgcagtactttatagaactaagttgtaggagctaagaggatcttttaattcatgctatgcaattatgtattttttgttgttgttgtattttattttattttgatttgtatgactttggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaaggtaggttcagtcagctagcttgtaagtaagtttactaccactttccaaattacattagtttgaatttccgtgtgtaaattgttttagtttggtgtgggtgtgtgtgtttgtgtttacacatatacacttttatatttatttacttatttgaaatacattttcagttatctttgggtagtcttgaaccttactgtgaatggcaatgttaggaacaagcctgtctagaaaaactatgtttaacattaggattattaaaatgtttctgtttcaaacattttaatgaaagcctttgtaatttgtgcatatttaatttcctatgtgactagaaatcagtgaatattcacttcctaatgaataatcatctttgaaatgaatattttactggcctagagatgcaggtagtatctggatccttgatcttgctttctcgaaacagtccccagtagcagcttgcctaatattgccaattctttcctcttgtagaagcagaatacagaatatatggttatattccttcccaggtaggaagagatggctgcctttctaggaaatgattttattcaaaggcagaatatgaatatgactttaaaaataaatatcttactgctgcatttaacctgattggcttcattgcctctatcaaaattctttggttatctagccatttttaaagttcataaaaaattgctttaggagttggtttataatgagtttatgggtaagttgtggaatacatcactattttgtgaacttcaatctgtacctggaaaaaatcatattacatttttgcattaagaaataaatgagacttggaattttttcagttcattgttttctgttagattcattatctttgggaattttggtcagtgtatatttatatttataatatacattgagtattatttagccatagctaatgtgagccctattaaattatattttaatatgcagaatttagcatagcttaagaaatatatttttgaaaataatgtttaagttgaaatcaaacattgaagacacattttcagattcacaagtagatttcataggaactgaaaatgtaatcaaattgtacttgtatctggacttttaaaaattcatatgatatacatatcataaacctcatttatttatattaccatatttatatttcaattgaatgtgtggaagcaatccagagtggtttcctatgagcacaaacaacttaaatgtttttttgtatccatctaacattgtcttagaaagcaaggatcatttgtttttatgtagtacacagggagaatgccaatgctactgattaaatacattgtttaaatgctaattgtactgttctctgtaactttcaacatctgataaactatgttcctcctaaaaaatgtcatgaggttttcactaatccccctttaaaatgataaaagaactatgaaaacatagagtgcttactttgtgccattatgtttaattgccaggtttaatttggctgaatcttataagttagttgctctgtctggcttaccaattaattccaagttcccattacagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaaggttggtatatagaaaataatgtgggcacatataagacataagtattgtgttcaaactcttacatatgttttgcactgacaatagaactttagataatatgtgtccattggaaaacaacaggtgaaatacttttggggtactaggggtagggaaagaggggctaggagacgatgtggttgcatatgtcacttcatttcaaataaaggaaataatattttctgtttctctagacttaaataatctaatcagaatgtggaaacattctttaattcactttctttatgcattaagcaattaaaaagagggcaagaaagtccctacaactgccctaggtcatgtaatattgatgttaatcattcattcttttagctaagcacccacttcttaccacttgatgtgtgactactgtgccttgaatatgtatgaccaatttggaaaatgactggttattgggattttacaagcactttaatatgtttagactcacagaattgctccttcttgccatgcagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtagatttatgttccccatgactttaaatataatttttgatagactgagtatggtagtgtgttttctcattgcccaagtatatttctttattcacagccaatcaatatttattaattatcttgtatgtgtacagcagcttttgagccagattaagtacataaaaatgtataaggcatacatctgtcctcagggaaccttgagggcttgttagaaatgaagtgaatgattctgataaaattcattaattcaacaagtatttgttgagtgctttctgtgtgtcacacactgttctaggtactgagaatatactgaggaactagatagacctcatctccgttcttacagagttttcattttattaagcagagctgagcaataaacaactaaaaataaattgatctgataacagtaagggctctgcttgtaaaattgggagacacaattgcgagtgctgttggtgaggatgtgatatttcagctgaaagatgcattaggagaaagaggttagaagggtgagcatttgggcagaaggaacaatagcttctgcagaggcataagctggcatgtttcaggcatggaggggttcatgtggtcggggcctggagttaaggggataacagcacaggatagaccagagggcccaatagatgttcgatcacatggaacctcctaagccaggttaaagatgtccattgctcaatgaaataaaagaggacacaaacaaatggaagaacattccatgctcatggataggaagaatcaatatagtgaaaatggccatactgcctaaggtaatttataaattaaatgccatccccatcaagctaccaatgactttcttcaaggaattggaaaaaactactttaaacttcatatggaaccaaaaaagagcccacattgtcaagacaatcctaagcaaaaataacaaagctggaggcatcatgctacctgacttcaaactgtactacaaggctacagtaaccaaaacagcgtggtactggtaccaaaacagatatatagaccaatggaacagaacagaggcctcaaaaataacaccacacatctacaacaaacctgacaaaaacaagcaatggggaaaggattccctatttaataaatggtgttgggaaaactggctagccatatgtagaaagccgaaactggatcccttccttacaccttagacaaaaattaattcaagatggattaaagacttaaatgttagacctaaaaccataaaaaccctaggagaaaacctaggcaataccattcaggacataggcgtgggcaaggacttcatgtctaaaacaccaaaagcaatggcaacaaaagccaaaattgacaaatgggatctaattaaactaaagagcttctgcaaggcaaaacagactaccatcagagtgaacaggcaacctacagaatgggagaaaatttttgcaatctatccatctgacaaagggctaatatccagaatctacaaagaactcaaacaaatttacaagagaaaaacaaccccatcaaaaagtggtcaaaggatatgagcagacatttctcaaaagaagacatttatgcagccaacagacacctgaaaaaatgccgtcatccctggtcatcagagaaatgcaaatcaaaaccacaatgagataccatctcactccagttagaatggcgatcattaaaaagtcaggaaacaacagatgctggagaggatgtggagaaataggaacgcttttacactgctggtaggagtgtaaatgagttcaaccattatggaagacagtgtggcgattcctcaaggatctagaactagaaataccatttgacccagccatcccattactgggtatatacccaaaggattataaatcatgctgctataaagacacatgcacacgtatttttattgcggcactgttgacagtagcaaaaacttggaaccaacccaaatgtccatcaatgatagactggattaggaaaatgtggcacatatacaccatggaatactatgcagccataaaaaggatgagttcatgtcctttgcagggacatggatgaagctggaaaccatcattctcagcaaactaacacaaggatggaaaaccaagcactgcattttctcacttataggtgggaattgaacaatgaaaacacttggacacagggcagggaacatcatacactggggcctattggggggtggggggctaggggagagataacattaggagaaatacctaatgtaaatgacgagttgatgggtgcagcaaaccaacatagtacatgtatacctatgtgtcaaacctgcacgttgtgcacatgtacccttgaacttaaagtataataataaataaaagatttcattctaagtgcaaataggatgccattagaaaatcgtaagccagagaacaatgtcaccagattgtcttttaaagcagctcatttaagtctagtgcaaggaaaatggattcaagaagctggtggggcagcataggagcaggaaggatggctaggaggctgtttatttccctctactctccatgtcaaagctgatggtggctcagacaaggtggtggaaataaagatggcgagaagtgggtatacattgatatttggaagaaaaattcattgggctagaagtagaggctgagggaaagacaggaatcaaggataactccttgaatttaagtttgagcagctggataatttgtagggttgtttactaagatgcagaagctcaaggagaaattaagagttctgttttgggcgtgttcttctgagatactactgacatcccaggggagggtggtcacataggcagggcagcatgcgactgtgtgttgtggggtggtcagggctgcagatgcaggtctggaagatgttgacacatggggaggtgtttgaacacgtggggcctaaggggcatatctggaaacaggaaggatatggtgctgagtcctgagcttccaccatttagagatcagaggaaggagaaccagcagagaagcttgagaagtaaaggaggaggaaaactaggaaagcaggtggcacatgagtatcacataagccaagacgacaggacatggtgtttcaagaaggaaatagtcagctggagggctgctgatgaaagattaagaagcaaaaacaagtgcccaatgttctttctttgtagattgtgtgagaggcataccatttcaaatcatagaaatgtagaaaactttgtttcttataacaatgtatgaagatttccgtgtcttttacactaggaatataagtagatttagcatttttgcatggtctacagcagagtttttccatggttttgttgtcttatttatataggttttgattggcacagcctgtgcacacagcaggacagtattgtacttatatatttttaaaatgtttatatttctctaatacgtattttaatatagatttttatatgtttttatcctatgtgatgacaaattattcatgaatactataggtatgtagtttatagttgcaaatatctttttgtctttctttctttcttttttttttttttttttgagatggagtttcgctctttgttgcctaggctggagtgcagtggcgtgatcttggctcactgcaacctccgcctcccaggttcaagcaattctcctgtttcagctccgagtagctggaattacaggcgcctgccaccacgcccggctaatttttgtaattttagtagagacggggtttcaccatgttggccaggttggtctcaaactcctgatctcaggtgatctgcccgcctcggcctcccaaagtgttgggatcacaggcgtgagccaccacacccagctgcaaatatcattatttttaacaaaaaaaaacaagtttatgaaacaggaatttgatggaattatcctagaataattttcctatatgtgtatatattttcttaatactagataccctgaaatagttttttgcttaaaattgatctctattaaagaaataccaaaaccaaaaacatcccgcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccgtatgtatggctttatttttctcacaaaatgtggatttcatggatttatcagaaaatacatttacatttgttgaaactctataagcttgtgataaattggaaattataaaaccaaataatatcataataattctgaagggtcaaactttttggttttcatgtcagctcattgcatagcctgattattggtaatattttttttaaaaacattttagtatatgatacttattttataagcttggagaaaatttggtgtttttggaatatttgacagttttagagcagaggtatttgttatagcataccaaacattggatatctttgtcttcagggaatgtaaaaattattaactagttatattccagatagtttgaaggaaaaaatggtacttgtttagttaaggcaaaaagtgctgggaccaagactactgaaaataatgcagagggatgacccatttttttgaagtttgtaaaatactcttatttgagatctatatcagtcagagttttcctgagaaacaaaaccagtaggacagacatgcacacagacacagacacacacacacacacacacacacacacactcacacacacagcagggtggagggagagagagagatttgaaggaacagactcacatgattgtgagggctggcaagtccaaaatccatgaaataggctggcaggaaggaaactcaggaaagagttgaagttgcagttttgtggagcagagcagttcagtaagctaaaaactcaagcaggattcctaagttacagtcttgaggcagaattcctttttctccaggaaacctcagtttttgctcttaaggccttcagttgtttagatgaggcccattcacattcttgagggtgatctcctttacgtacagtcagctgattgtaagtattcatcatatctccaaaataccttcacagtgacatctagatgagcgtttgaccaaacaactgggcactatagtcttggcaagctgatacacaaaattagtcctcacagggcctgtttgcttcactccatgtatatcatagctagtaggaagaatttagctaaaattaactgattaaatgtagtaaatatgagatgaataaagcgaaattcaggcatcaaattactattctcttgggattctacaaatgggagttttctggattcttattcccatcatctttggggaataagaacctacttgttttaggtaacagtcaatgtgataaagaagttttcaaaaattaggtagctaagtagagtatattcaagtgtcatttttatgtttctttcatttcctcagcttctctgtttgttaatatgttggatactataatttcatccctattgttttataaattattttctctgttgtttatattttttagatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtattacttttcatttgatttttcaaagtaccagtttgcctaacaaatgtggttaagagggacagggaaactgcatgttctagttaattaaagtttttgataaactaaagttacgtgagttttcagagaaacagaggctttatttaaacatctttgggctctctcatcagcatcaacctctagctatctctctaaattaaaattggttacagttagttcagaaagattttcctcacacttaatcataaagaaccaaatgattttacattttattgtttgctataatgtgaaggctttcctacttaagcctctcaatgatttgtgtaaattctccagggccttatttctcattagaatttttccatttagcaactgttttttaagaggttgtctttgcatgtatatttagatagaatgtttggggatgcccttgtaagttttcatgatatttgattaacagatcaaggtaatttgtttgcaggaaaaacatattttgtgaaatttctctatacactgacctctctttctgtattggatattaactggtgcttcttcagttgacacttcatagttttgaggccagcaattcttggaaaataatgattgattttttatatctcatagatagtccttttttattaaaaacaaacaaaaattctgatttgaattgtcaaattatctactttttaccttgaaatactgtgtgtggtgtactactaaagttatttgtggaactggaatttttaaggtagcttgcttctctgtgtcccttcaaattgtgctgttattttagaagcaggtaaaataatgagattttgtaatcttatcctgcaaatagcattcaacagcctgagtcaatataccttccaagctaacatatacttagagagtttggctttgaatatagtgatgcacaattatattttttttttgtatattatagagaaaaacataatttaagggaatttggtgcaatatactgaattatataactttgttgagtttttttcttttattttaggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtttgtggcatttcttcagtttcctgatcattccaataaaaccctttcaggagtgcccatgcttacctcataatcagtttgaaatcttattcaggtatttaaatggaaccacaaaaaaatgccctcgaaaatgtttagtaactactggataatacatttgcagattataataagtatattactatttggatggagataatagatttttgtgtagaaagtaacagacacttatttaatacttacaaagttctaggaaatgtttccagtggtgtgcatatacacctgcacacccatggacatgtgtatgcacacgcacacacactgatacttgtcaaaggggagaaatttataggcttctttgtgcttctagcaaagagtagtgcaatgaaatagattacatgaagaggatttgtgaatacagagactggtaactgcttctctttttgaaaagttgaaatgtaggaaattggctatgatattctctaatggtaatgaggagaaatcatagcaggctgctctgccaagatctggggtgggtgatcagaatgcatggatgtcctgtggctcaagcagacagcccagcagtctttctcagtctgaaccacagaaagtgattgagtgactttttttttaattcctcccaaggatggtacatgtcatatcatcctctgtgcatgcattatggcattcattgccactggatgcattatggcattgggattaattatctcatgggcaagaaaggctgtccaagaagtagacagattggtgtcatcttgagaaaaacttgcagggtgaattatgtagctagagagaatgaaaaaggagaatatattctctctgtcgaggaatggtgaagaggggaattctgaagcctttgggaacacccaaatcaactccatgaaggcttgagcatttgggtgctgctttcatggaggtgtgttattcagccagtgtcagcttagtttcatataaacttgtgatccatagaaaataggctatcatttccggataagcaacaagcctattacactaatccatacttacagtgctaccttttgatgtgttgtgtactcgagccttttgtagttgcttaataaagaaaacaaatggggtcttcttagtgagacatgggtttcatagctattcctacattcctgtacaatatgtcctcagttaatgtccacaggttcttggaaactgcagctttaagtgaaatgatgtacaatgtaaccaattttaccgtaagctaattgatataaaaaacaatagttaagttcctacagcatatttctggtcacaaaaacagcgccagacttataataaagatcagctactttgaaattaaacattgaaataaatgtgagctatacctgcatttgagaaagagtaataaaaacaaaataattattcaccctatttttccatttcaaggttgtaggttgccagagccttccatggtagctcagggctcaaggcagggatcaaccctggacaggactccatcccatcgcagggcacagtcacactcacacccacactcactcagactggaatcattgacacatgctgattcagcctcacgtgcacatctttggaatgtgggggagactggaacacttggagagacccatgcagatatggggagaatgtgcagactccacacggacagttgccctggctggcaattgatttttttctcatcaacattatatgaaacagcattgagtgaaactgtgtgatttgaagacctgttgtagttccttgggaaactgactcaatgtcatgaccttactttatcaatttctaacctgcatttcctgtatccgacagctctcaaggctaaacagtacaaaaatggaaaaagagaagtggattaagttaaccagagtatcattgtatcaagtctcacttacaaattagaaaaagtttaaaaaatacaatatgcctaaattgtgtaactcgaaacattttcccatgtattcatagcattacattctgaacatattcaatttataagctgctaaagaacactagggggcaatcctttaacttttccagaaatagctggtatcattttatagtaagttttcatttgacaataaggcaggccaaagagaagattagatattgtattgttttactaagcaacgtgtatagtacaaaattgctctcaggcataagaaacccaaaatatgtgatgtatattacatggactaacacccttgatctgcctagttgttagattgtttttcacggtacctggaacattttgaagcatgtggtagtgcacttttcatttcatttgaaagcttagcattgcatttcataaaaatacttagctttcctaatatgataaatgaattatcatttatgaatttcttaatattgtctttgaacccattttaattatttttatgatttctattttcataaagagtgacaaaagtttactagtttatgcatgcataaaaaccctcttttttggtcactttaatatctctttttaacctatttcaagttgcacagcttccttctctctggcacattccaggattgtggtgtaagactgcacatagatttttaggtgttggtgagttagtcttccaaggaactgtttggggaaaggtgtgacatgcacttaaaccaaagacaagatttttttcaacggtttctttcttccctctcacccggtatataacccattgctctttgaagattgggatattagttacaagagtttacatcctgtcctccctcttctaccttcttggataaaagttgagactttggacaggtaagccacagagaaggaccgcaagggccatgatgtatctaaccctctgtgctgtggcttctaacctgcaagtgggtcttttaacagggtaggtttccattaggctctaagaacaaaagagtcttgatgtaggtttaacaccagaaccttcgagtgtcaactgttagcacctggtaagttgttaacacctggttaacagctggcttttttttatgaggcacagactgacaataagaatcattgacctgctaaagaaacaagcctaggcttgaaatactttttcagaatgcaagaggaattttatatttgtggctgggtcatttattgagcacttattatgtgccaatcactgtgagaagctcagcagatacgaagatgactgagaaataattcctggtgccatgttgctccctgtctagtgtatgaacagccagttataagagcatgtggataaatagtgttggcatgtgcacagggtgttaaggtaccataaatcgtttctgtttgtgcccaatgccatcaagaacaataggcaggaattgctggcaagatggccgaataggacagctctggtctgcagctcccagtgagatcgacgcagaaggcaggtgatttctgcatttccaacttaggtacccggttcatctcactgggactggttggacagtgggtgcagtccatggagggcaagccgaagcagggtagggtgacgcctcacctgggaagcacaaggggttggggaatttttgcccctacccaagggaagccatgagggactgagcctgaagaaccatgcattctggcccagatactgtgctttccccatagtcatcacaacctacacagacaggagactccctctggtgcctacaccaccagggccctgggtttcaagcacaaaactgggcagctgtttgggcagacaccgatctagctgcagaagtttttttttttttttttttttttcccttacctcagtggtgcctggaatgccagcgagacagaaccgttcactcccctggagagggggctgaagccgggaagccaagtggtcttgctcagcaggtcccacccccaaggagcccagcaaactaagatctactggtttgaaattctcgctgccagcacagcagcagtctgagattgacctgggacgctccagcttggttgggggaggagcgtccaccatggctgaggcttgagtaggtggttttaccctcacagtgtaaacaaagccaacagaaagttcgaactgggctgagcccaccacagcgcagcaaggctgctggggtcagactgccagatttctcctctctgggcagggcatctctgaaaaaaaggcagcagccccagtcagggacttatagagaaaacccccatctccctggcacagagcacctgggggaaggggcggctgaaggagcagcttcagcagacttaaacttccctgcctgacggctctgaagagagcagtggatctcccagcacagcgttcaagctctactaagggtcagactgcctcctcaagtggatccctgacccccgtgtatcctgactgggagacacctcccagtacaggctgacagacaactcatacaggagagctctggctggcatctggcaggtgccccgctgggtcgaagcttccagaggaaagaacaggcagcaatctttgctgttctgcagcctctgctggtgatatccaggcaaacagggtctggagtggacctccagcaaactccagcagacctgcagcagagggacctgactgttagaaggaaaactaacagaaaggagcagcacatccactcagagacctcatccaaaggtcaccaacatcaaagaccaaaggtaggtaaatccacaaagagggggagaaaccagagcaaaaatgctgaaaattccaaaaaccagaacgctgcttctcctccaatggatcacaacttcttgctagcaagggaacaaaactggacagagaatgagtttgatgattgacagaagtaagcttcagaaggtggataataataaactcctccgagctaagggagcatattctaacccaatgcaaggaagctaggaaccttgaaaaaaggttagatgaattgctaactagaataaccagtttagagaagaacataaatgacctgatggagctgaaaaacacagcacaagaacttcgtgaagcatacacaaatatcaatagctgaatcagtcaagcagaagaaatgatatgatagattgaagatcagcttaatgaagtaaagcaagaagacgagattagagaaaaaaaaaataaaaaggaatgaacaaagcctccaagaaatatgggactatgtgaaaagactacgtttgattggtgtacctgaaagtgacagggagaatggaaccaagttggaaaacattcttcaggatattatccaggagagcttccccaacctagcaagactggccaacattcaaatccaggaaatacagagtacaccaaaaagataccccttgagaagagcaaccataagacacataattgtcagattcaccaaggttgagataaggaaaaaatgttaagggcagccagagagaaaggttgggttacccacaaagggaagcccatcagacaaacagccgatctctcagcacaaaccctacaagccagaagagagtgggggccaatattcaacattcttaaagaaaagaattttcaacccagaatttcatatccagccaaactaagcttcataagtgaaggagaaataaaatcctttacagacgagcaaatgctgagagattttgtcaccaccaggcctgccttataagagctcctgaaggaagcactaaacatggaaagtaaaaccggtaccagccactgcaaaaacataccaaattataaagaccatcgacactatgaagaagctgcaccaactaatgggcaaaataaccagctggcatcatgatgacatgatcaaattcacacataacaatattaacattaaatgtaaatgggctaaatgtcccaattaaaagacacagactgccaaattggataaagagtcaagacccatcttcaggagacccatctcatgtgcagagacacacataggctcaatataaagggatggaggaatatttaccaagcaaatgaaaagcaaaaaaaaaaaaaaaaaaaaaaaagcaggagttgcaatcctaatctctgatgaaacagactttaaaccaacaaagatcaaaagagacaaagaaggccagtacataatggtaaagggatcaatgcatcaagaagagctaactatcttaaatatatatgcactcaatacaggagcacccagattcaaaaagcaagttcttagagacctacaaagagacttagactcccacacaataataatgagagactttaacaccccactgtcaatattagacagatcaatgagacagaaaattaacaagggtattcaggacttgaactcagctctggaccaagtggacctaagagacatctacaggtatctccaccccaaatcaacggaatatatcttcttctcagcacctcgtcgcacttattctaaaattgaccacataattggaagtaaaacacacctcagcaaatgtgaaagaatggaaataataacagtctttcagagcacagtgcaatcaaattagaactcaggattgggaaactcactcaaaactgggtaaataacaaaatgaaggcagaaataaagatattctttgaaaccaatgagaacaaagacacaatgtaccagaatctctgggacacagctaacacagtgtttagagggaaatttatagcattaaatgcccacaagagaaagcaggaaagatctaaaatcgacaccctaacatcaaaattaaaagaactagagtagcaagagcaaattcaaaagctagcagaagacaagaaatagctaagatcagagcagaactgaaggagatagagatatgaaaaatgcttcaaaaaatcaatcaatccagtagctgattttttgaaaagatcaataaaatagattgactgctagccagactaatgaagaagaaaagagagaagaatcaaatagacacaataaaaaatgatataggggatatcaccactgatcccacagaaatacaaactaccatcagagaatactataaacacctctatgcaaataaactagaaaatctagaagaaatggataaattcatggacacatacaccctcccaagactacaccaggaagaagtcgaatccctgaatagaccaaataacaagttctggaattgaggtagtaattaatagcctaccaaccaaaaaaagtccaggccaagacggatacaccgccgaattctaccagaggtacaaagaggagctggtaccctaccttctgaaatgattccaaacaaaagaaaaagagggaatcctccttgactcatttcatgaggccagcataattctgataccaaaacctgacagagacacaacaaaaaaagaaaatttcaggccaatatctgtgatgaacatcgatgagaaaattgtcaataaaatactggcaaaccaaatccagcagcacatcaaaaagcttatctaccatgatcaactcggcttcatacctgggatgcaaggctggttcaacatatgcaaatcattaaaagtaatccatcacagaaacagaagcaatgacaaaaaccacatgattatctcaatagatgcagaaaaggcctttgacaaaattcagcagcccttcatgctaaaaactctcaataaactaggtattgatggaatgtatctcaaaataataagagctatttatgacaaacccacaaccaatatcatactgaatgggcaataactagaagcattccctttgaaaactggcacaagacaaggatgccctctgtcgccacccctatttaacatagtattggaagttctggccagggcaatcagacaaaagaaaggagtaaaggatattcaaatagaaaaggaggaagtcaaattatctctgtttgcagatgacatgattgtatatttagaaaaccccatcatctcagccccagatatccttaagctgataagcaacttcagcaaagtctcaggatacaaaatcaatgtacaaaaatcacaagtattcttatacaccaataacaaacaaacagagagccagatcacgagtgaactcccattcccaattgctactaagagaataaaatacctaggaatcaaatttacaagggatgtgaaggaccttttcaaggacaaccacaaaccactgctcaagggaataagagaggacacaaacaaatgggaaaacatttccatgctcatggataggaagaattaatatcgttaaaatggccatactgcccaaagtaatttatagattcagtgctatccccatcaagctaccattgactttcttcatagaattggaaaaaactaccttaaacttcatatggaaccaaaaaagagcccgcattgccaagacaatcctaagcagaaagaacaaagctggaggcatcacactacctgacttcaaactacactacaagcctacagtaatcaaaacagcatggtagtggtaccaaaacagatatatagaccaatggaacagaacagaggcctcagaaatacaccacacatctacaaccatctgatctttgacaaacctgacaaaaacaagcaatggggaaaggattccctatttaatcaatgctgttgggaaaactggctagccatatgcagaaaactgaaactggaccccttccttataccttatacaaaaattaactcaagatggattaaagacttaaaagtaagacccaaaaccataaaaatcctagaagaaaacctaggaaataccatttaggacataggtatgggcaaagacttcatgtctgaaacaccaaaagcaatggcaacggaagccaaaattgaccaatgggatctaattaaactaaagagcttctgcacagcaaaagaaactatcatcagagtgaacaggcaacctacagaatgggagaaaatttttgcaatctatccatctgacaaagggctaatatccagaatctacaaagaacttaaacaaatttacaagaaaaaaaacaagcccatcaagaaatgggcaaaggatatgaacagacacttctcagaagaacacatttatgcagccaacaaacatgaaaaaatgctcatcatcactggtcattagagaaatgcaaatcagaaccacaatgagatactatctcacaccagttagaatggcgatcattaaaaagtcagaaaacaacagatgctggagaggatgtggagaaataggaatgcttttacactgttggtgggagtgtacattagttcaaccattgtggaagacagtgtgacgattcctcaaggatctaggactagaaataccatttgacccagcaatcccattattgggcatataccgaaaggattataaatcattctactgtaaatacacatgcacacatatgtttattgtggaactattcacaatagcaaaggcttggcaccaacccaaatgtccatcagtgatagactagataaagaaaatgtgacacatacaccatggaatgctatacagccataaaaatggatgagttcatgtcctttgcagggtcatggatgaagctggaaactgtcattctcagcaaactaacacaagaacagaaaaccaggcaccacgtgttctcactcataagtggtagttgaacaatgagaactcatggacacagggaggggaacatcacacacttggggcctgtcggggtgggcactaggggaggggtagcattaggagaaatacctaatataggtgacgggttgatgggtgcagcaaaccaccatggcatatgtatacctatgtaacaaaactgcatattctgcacatgcaccctagaacttaaaatataataataataaaaataaagaacgaatgataggcagtatagaaaatggtattggtgatgcagtcttggattacggaaatggaagagcgtattgagaacatgatcaactcctaaaaactttcaaattcatttttaaattaatctaacctcttttcttctgtaggtgaaccagcttttcctcaaatctgctctaactcatgttccattttagcatttaattaccgctccctggggatctgccacatcatacaaatctgtgtgtaccggatgggcctgtgagcagaggagctaggcgggaaggcacaagtgacctggtgctttaagctgacacctggctattcactcttaggaaaataaagataaagaaaaatcattagctgcccagccagtgactttcatggggggaggggtacactcttacaggagaggtgcgatatacatgattaaaatttttctgtgatttatttgttttttttttttagcacttgacccatgattcatgttcagtgaatgtcattttgaatgaataaaacacctgttaccctcatgttgcccaatatttgaaaccatcatggtatatattttgcaaatttgaggatgtgttgtctaaattcattatatttaaaagaagaagagactttacagaaatggttgatttttacattcaatcaagatatgcaaagtttttgggaatattccaggttgtgagataacttgggggttattaccaagaccaacgtttctatgggaaaatgtgctgtaagtttcaaaaataactttttgcataacatcaatacataaattccagattccccctattttgttggattctaaaattttgaaaatatgtaacacataggattaatttttatttatccaacataaatcagtacactgaaattattcattttgagtaaatatgatgaattattagtattcaatgaggaggaggaaattattcaatgaggaggaggaaagtgagttttgccaagtttataggagctgacactttgccagagtgccccttccgttttcttgatacttgatcctatcatgaacactgcctgtgtggctactgtcattggtgaagccatttgggcacatgtgaaaaatttgaaaatttgtgttttttttgtttagttttgtttgttcttttttgggggagaaggggagacggagtcttgcactgttgccaggctggagtgcagtggcacaatctcagctcactgcaacctctgcctcctgggttcaaatgattctcctgcctcagcctcccaagtagctgggaccacaggtttgcaccaccaagcccagctaatttttatttttattttttattttttattagtagagacagggtttcaccatgttggccacgctggtcttgaactcttggcctcaagtgatccacccgcctgggcctcccaaagtgctgggattacaggtgtgggccactgtgcccagccaatttgtagttttttatactctacatcttccactccttatctcacaccctacatactggtggtttgttttgtgatggggaaaagtgcatgtattgatgaaactgtttgctactaaagcaacctcaggcattatgctaatggctcaagtcaaagaacagcatttttctctgaaaattatttctaaatcactgacactgtttgtttataggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtaattggccctgtgtgtggttctctcagcagaacactagagggcagcttttacaggaaggacggagactcttagagctagaatttctcatgagtaactattttcttaaatataaataactctgtgaatatcaaagtagatgtaacagatatattatataaaataattagtctattttcaacattcagtaggaaaaaaagagatatgtccatatctcttcttgatattttgtatctaatattgaggtattttatgttaaataattaaaattataatgaagcactaatattccacactttttcgcatactaacattgtgaatgtttatgtttaatattcagactttggtttacaggggcgagtttgtcttgatgtagataaatgctgatggtcagatcctgtgatatggttgcaactaagtatttgcatcttctgtctgaggtcgttgtaggaaagattatttcccaatcatttcataaatgcacatgagaacaaagaacaacttgagggctttcctttcctttcaggcggattctgtcaatatatgaaaaagacaaggctgttatctgtggctatggtaacgtgtgtatgtttgaagccattgtgtgatataattctatcctactccttcaggtgggagctgaagtgactcgggcaagcctggctcaagatgctgaggtggaatctgtacagatgaatgggcaggaatatgggcagatatagtctctggccactaagggatgctcttcagctactcccgcctgagcatcttctccaaggagaatgaatgtgctttttctcttaaaatagaatacactggctattaaaataactgagagtaaaaggttttttttttctttacctcctcttctttaagagtgaatgaggaaatagaattgattaatgctttgaattttgttgtcttctttttgttcatgtgttgttataaaaaaaaaagattcagcaaaaccattcatttggaggaaaacatttcctactccttatccatgcacattgtcacaatactgtatcaccccaaagggcaaggttagagtccatcatggtacattcacatctttggtgtaacctctatacttgtatcagtgtttggtgtgtgtgtgcacgcatgtgtgtgtgtatgtgtgatgtggctagggcatttcaaaatagccctctagtcatgtagcaagaatgatctcactcaaagcttttggcagttgctaagcagaagcctcactgggctgggcatggtggctcatgcttttaatcccagcaatttgggaggcccaggtgggtgaatcccctgaggtcaggagtttgagactagcctggccaacgtgataaaaccttgtgtctactaaaaatagaaaattagctgcatgtggtggcatatgcctgcagtcccagctattggggaaggtgaggcatgagaatcacttgaacctgggaggcagaggttggagtgaaccgagatcgtaccattgcactccagcctggatgacagagcgacgctctgtctcaagaaaaaaaaaagaagaaaaagagaagcctcactgtaacagagaatctaggctggggtcaaattaaagtagttgttgtttcttttcctctgtggctccagaagttatcctgcggaaccctctcatgtttttctgttattcttcattccaatttaagaaggggagaatgagttttaatatataactcttgattaaatggtatcccaaatttatagctattgagaccaaaagaggtaaactgaattgttcaaatcaaaatgtgaagccaggaatctgcttttattcttactcattgctcagaacttatttcatctataaatcacataccctgggaacgttgcacataaaacaaaatcttacttgatgcttgtgataaagatgggtattaaaaaaaaactttgaagttttctggtcttcaaaaaaagatataaaattaagtcagagctgaaaagaaccctaatagaaggtctagttcatggtgcttactttataaatgaaaaaatacactattatatcttagaagtcaaattttagttctacaaatgaggttctggaaagacccatgaacaagtcatattaaatgccatttaacatattttgctttcatttaaccataattatgcttatctttttttggatgttgttcattcaaaagataacgttttgattaaaaaaagaaaaagctatcaactataacctaaataataaagtaaaataaattttaaagtctgagatgttatttcttaagcacttctctttaattcagtatgagacaaggatatatattgtataaaccaagggaaagtttacgtttaacccattcctcagaaaacaggaaggtttagagagaaataaaatactctaagcatgattttccctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactgggtgagttgtagtttttctaagatgagtcctgtagaatattggaaggatatcactggccactaattgtcttgggttatccttattctggacactaaatgtagttttcgaatacaatgctcccatatttaagtgatcagagtagtgcaggctgcttggtgagaaaaggagagaagcttttttcagtcaaattaacaactccatgccttacctcaaaagactggggtcactaagcaaactactctgtccatacaataggagtttgttgaaagtagttctaagaatctaatttggcaaatacagtaataagaaaaataaaaatacatacagctcttgtatgcatttccatgttcacctgactatttctggcagtagggcagctgttactttagatactttattttttaaagtataccattaggtctttgagagctagtgagatgcaaatgttagatggtttgacctctaccgtgttatagcaagctcattgcaaatttagataatgagagtttataaagaaccctccagtgggctctgaatctgaggatctccctccttgattcacagggtcttgttggtcaccagccaaacgccatttacactcagtaagaaacctaatgaatcctgcagaggactgagatcctcagtctctcagaaaggagggaatgattttcattttcccaagatctcggcatcactgagagataagaaggaatgaaagctaaggtcctatagaagatgggggatgagggctaggccagtgaaaatgacaacattttcatgccagcttccatcctaacaggaatcccagaaaacagaaagagagaaattagctgcgtgattgagagacaccatagtgtgataactgccttggatactggggtttctttagccactgcataggtgcccctgatgtgatgtctcagacattgtctcctcttgttttccttttggcatgtcccctaagttaaagatatttaattattttttcctgtttattttctagccctttttttcctgcagaaactcttgtcttttacttccttacccctctgtcactttgggtgatatgcatagcttcatataatctagggtgtttgcaaaaattttttatgttagtaaccacttgctacatatgaaaagacttatgtgtagaaatattgcttattatgagtgtatatgcggctttgtgcttacatatcacattagtcttcaaacgcttttgtgagtttatgttaacttgattcagctaaaataacaggagttcccaaataatagatctgtatcttcaaacaggttcatttagttttttgagcctttgtaataaattttcaaacacaatggaaagtacagtgaacacccataaactcactgactagatttatttatttattttatttttaatttttttttttgagacagagtcttgctctgtcacccatgctggaatgcagtggcgccatctcaactcactgcaacctccacctcccgggctcaaggtattctcctgcctcagcctcctgagtagctgggattataggctcgcaccaccatgcctggctaatttttgtattttttgtacagatggggtttcaccatgttggccaggctggtctcaaactcctgacctcagaatccgccctcgtcggcctcccaaagtgttgggattacaggcgtgagccactgtgcctggccttgactagatttaatagttgttacagtctgctatatttgtgacattttttctgaagcattttaaagtaaaatacatagattatgatatttcaccccaatctacttcaatatgtatcctaaaaatatgctggggccagaatttaaaccaaagcctgacactaagtctatattaaagcttgcctaacaccagtatcttttcactactggattttgtcattgagccaggaaagaaaaagatataaaggagaaaagtaaacagggaccgaaagcaagatttgtgtggtctcctgtaagtttacctctcccccgacccctttttaaaaatgttttaccttttgtgaactataattgaattttggaaaagaaaatacactactacagttttaaaagtcaaatcccaatttaagaaaagaaataataccctactttgctttttcatgttttctttcagggagcctttcattttcccacggtgaacaaaggaaaggagttttcctgtggacgtttcctagccctggttggccagaggcctttgttcttcacctatcaggagtgcagagcagtgctcctggcggagctcaactccggtaagaccaacctcattctcacccaagaaattctctgaggaataatctggaattcatccatcaaaacagaaaaaggcacaagggttattctccttgaagcaaacacaaacatagttttagtgtagagcatcacgtggcgtgcatgctggagagggaggtggctcttaggagccccaccacccactgtttgctctaaagagagctcctcatgccccaccttgagaatggggtctggggtaccatctccactaagagccatgatggcagttctcctcttgttaaagacagctatcttctgagaagctgaaaatacctgattgccccaagtgattaagagtaagaataagattaagtaagaataagacatcacagtagggtgataatattacttatttggaccagtggccctttgactttaatttaattttattgaattttactatgtatctataatgactgtttctgcaaatacagtatatttgcagataaatacgtaccagccaaaagcaatttactttccttatttctgggatagactcgaccagagcagcagagggcagacctgctattcagacttagggatttagtcctggctctgccacttactcgctgtgtaactttgagaaaattacttgatctttctgttcttcagtttacttgtaaaataaagaaaattttggggtatgaaaactagagtgtattcaagtatgtttgtgtacatgtttatgtgtgggggatctccattggggaaataaaatatgactttagattatacatatgccatttttaaaatgttcatccagagaacatattttagggttacaaattcaaatgctttaacagcaacaatagttattaacagtattatagtgcttggccaggcgtggcggctcacgcctgtaatcccaacactttgggaggccacagcaggcagatcacctgaggttaggaactcaagacaagactggccaacatggcaaaaccccatctctacttagaatacaaaacatcagccaagtgtgatggtgcgtgcctgtagtcccagctacttgggaggctgaggcaggagaatcgcttgagcccaggaggcagaggttgcaatgaactgagatcgcgccacagtgctccagcctgggcaacagagtgagtgagactccgtatcaaaaacaacaagaagtagtattatagggcttaccctaggccaggcataaatgtttttttttttttgagatggagactcgctctttcgcccaggccggactgtagtggtgctagctcggctcactgcaagctccgcctcccgggttcacgccattctcctgcctcagcctcccgagtagctgggagtagttgggacgacaggcacctgccaccgtgccctactaattttttgtatttttagtagagatggggtttcactgtgttagccaggatggtctcgatctcctgacctcgtgatccgcccacctcggcctcccaaagtgctgggattacaggcgtgagccaccgcggccaggcataaatcttacagtgcttactctaggccgggcataaatacacacacacacacacacacacacacacacacacgctctgtctctctttactctccccagcaaccttacaaagtagattatattatttgtctcattttatagatgacgaaagtcatagatagattatgcgataaacccagaagcacacagttaatatatgttggggccatgatttcaacccaggctgaatggcctctgtgtgaggtattaaccactgttttatgtactgagtgctggctgcttgacaagagagagtaatgggacctgaagaatcctccctaaaggcatttaaatttatattaaaaccaaaaacttgttagcaaaagaaaataaacctgtagacagaattaggccgagagaccagcagttgtaacctctgatatagctattaactcacaacaaaaatctataggaaaaaaactaagaataaatgattctatcatgggtgtctgtcctcattcatacataaagttttagccacatttgcatgagaggttagttccattactggcagctgaagaaagcaaggattttactgctagtgccagtaactatttctatttggtagataacaaagctggcagaggtccagaacattgtagtaatattgttccccttgtactgatcctaagagagagcctgattttcacatccctcagacagctgctctgggatgatggagaaatagaccagagacctataagcttttcatttagctcagacttgttagttcctgtccctgcttttgcagctcctgttcttacatttcttttgcccttacatatcaataaatagggtttgatggaatttgaaatggcacgtcattgttaagttgctgccctcatgagcagcattttaaatatgtgaatgatgaatctctacagtcatattcctattttttaaaaaatcaatttcttcatgatttaatttttttcccagatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaag

SEQ ID NO: 358 - DNA, 676223 bp, Homo sapiens
tcctcctccattttttgtatgagaaatgataatgttcactatgtcttatcctgactgctctttggctttgccaaacatgttccttggaagggcctagcaggcctagtcaccgtgaacacatcatttaacagatagcacgcacctcctatgtgccaggtgcatatgcttgccttatgaagccacattctggtggaagtgcgagttttctctttttcctgtgagaattgtctgctttgggagatggtgacctttccgagtttgagggaaaatgaaacaaacttccagtggtagaatggcaatgtacactctgaaatctcttgttattgcaataatatagttggattgaggcttttctttatctttggagcatccatattttcttttcccttttttgagacagagtcttactctgtggtacaggctggagtgcagtggtgtgattacggctcactgcagcctctacctcccaggttcaagcattcctcctaccttagcctcctgagtagtgtatgccaccacgcctggctaatttttcttttttttccttttttttttttttctgtagagatggggtttccccatatggcccaggctggtctcaaaactcctgggctcaagggatccgcctgccttggcctcccaagttgctgggactacaggcgagagctactgtgcccagcccatattttcttgactgttttatttttaccttaatttagaagtaattattgttatgaatattctgttgcattatgtttgaggatgtttgtagctctagtgggaatacgggaagttttgatagaggcaaagacattgggcctgcagctgaacagcaggatcatggttatcatggagtctgtgcagtcagaattttccctttttgagcacttttattcatctgggtagacttttgatgttatttaaatttagaacacagcaagaaaaacagaatggaatttattttattttatcagtttttgcctgtaaaaatgaacttcttgtatgctcctgtaaatgtatatgatgttttactggatgcagttaaaaaatgaaaattaagagttgatggttagagttttttcagggtctttttaaagtaaaattttcatcttttcacttataggtaaaaagcgcagactcaccattattgaatgtgggtgtgacattaacatgatgattgatctggctaaagtagcagatctggtaagtgagcaggggcagcctggggtgctgatggagacttacagcattgtgataggttatttaccccgtgatgaagggaagagagtcttataattattaaaagaatcatggtcatcatcagtgatacggtagatatgattgaattgatgataattatggtaataaatgttgttatgttaataataaaaatggaatgtgcacaatgaaatgtgttccaaaatctaaaagcaaatcacaggatggagaaaacctttaatgaacacaactaataagagctcattaatatgtatacatatatacgtacaaatatatcatagtaagtaccatttcttcttggactcttcctggcactgtgctaactgctttctacaaatttagcttacataaacccttgatacacccttgaggtgagtaggtattatctgtagtttacataagatgaaatagagcctgccagcagttaagtaacttgtgtgaagttgggacccttgttcctgatggttccagaaccttcatccttaatgataatgctgaagtaagtacatgaattgccctgaagaagtggtcagtttatcaataaaaagtctagacagtcctcagtgtatggaaaatgtaaatgctcttgcatttatggaaatgatagtgttcactattctgatagtctattaactatcttttaaattagcaaaaataaaatacaaattagcaaaaaaataagccatattgattaggaagtgtggggtgacagacaccttgattttttcatttttatttagttttttctagacacctgtttggtgacaaagagctacagattttatactttggcccaggaagactcctaaaatataaagtaaaaagtaatacagattttaaagttgtgccattgtaatgtcagaaaactaaataacattcaaattttgaacatgtaatgttaatattagtaaaaataagtgttattattaacgtagtgtaagcttactaaatcttgtatacttgaaatgattgaaatagttcatagaagtcatttgtttctcttttatttaaaatgtagcaagcttctaattttaaagacatacatattaagagatacctttacttttttttatttttaattattatggatacataatagttatacatatttatggggtacatgtggtattttgacagaagcatacaatgtgtgatgatcaaatcagggtaattaggatatccatcacctcaaacatttatcatttttttgtgttaggaacatttcaatttcattcttatagttattctgaattatataataaattatagtcaccctattgtgctgttgaacaccagaatttattctaactgtatttttgtacctgttaacctttccctctttgtccctccctccctgctccccttcccagcctcttaaccatcattgagagagatgcccattatgtaaatcttttaaagatttttcaaaaggaacacacacatttggtaaagtactctaactgtaatgcagggtgcacacaatgtgcattttctttttccttagtataaccgctggtctctcagatccctgcagagcagtatccttttagatacatataaacacacatgccaccctttaaaaacaaatggtagcttattttacacactgttctatgctttgcttttttcatataatgtattttggaggtatataatcagtaagtactgcagctctgtctcctttttaatataatattccattctatggaggcaccataatttatttagcctagcttatgttgactgctctgctgtgggttgccaaagcctcctgtgtacagcaaaggcacacacagtacgtggatttgggtgtgtacaggcgtgtgtagattaggggaataacactggcttagatgacaaagactggcagctgagggactgtttgctccctgttcttcctgaccctacaatcagctgcttgccccctggcactctgtggcatcaaatgtagtgtgaggatattccgcctgtcctttgagctggtccagtgttgctgaaaagctgtgcttgctgcctcagtccacagtagcagctgtgctttctcacaagcccaccttcatatattctgtggtttcggattttgaatgtttcctagtttaatcaaagatgggcatttctgtttccattttttttgttatttttagttatctatgcaaagataagaacagaaatgtttttaatacttaaactagaaatttccaggaatcaattctgaaattattttgcatctttgaagcatcttaaattttaaaaattggtctcatctgcttatattttcttatagactaccattcatcgtaatcttactgtttttttttttacctaattctaaactggtagctatttaaaaaaaatttctgagcaattgagttatccaaattaacatataagatagaggtttccactgcatacttctcaacaaaaaacagattgtggtttttttttctatgaggcgattgaaagaagaggttggttttctgtacatatttaatgtatttcattgattatgactctcttcccattctttggatgccagagacctgttatttggcttaaaaataccttacagaaaacttgatttctttaaattaggatttcttaggtaagggccaggttagacccagccttttctgagttacttctcatacattaaaattcttataatggaagtttatatcctagtggacattgtcttatgggttggcttttagagcaagtcagagggtggtggtttctctgtctgggtgatgcctgtgtagtcatttgatttagtctggagtgcaacttttccgtccagggccaggtagtagatatttttggctttgtggatcatatcttctgcagctacttagctctgcagttgtagtgcacaggcagccatagacaatatgtaaatgaattaatgtggctatgttccaataaaactttagttacaaacacaggtgatgggctggattttgcccgtggccagttgccaacccttagtgtaggtggtctgttttggtagtttctttgagaaattatgtgttctgcttttaggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccggtacgaagagaaataattgttggatactaacagtataatccttttaaaatagactgaagaggccgggtgcagtggctaacacctgtaatcccagcactttgcaaggcagaggcggtcggatcacttgagcctagagttttgagctcagggcaacatgaccaaaccccatctgtactaaaaatgcaaaaattagtccggtgtggtggcgtgcgcctgtaatcccagctactcaggaggctgagaagtgagaattgcttgaacctaggaggcagagggtgcagtgagctgagatcacgccactgcactccagcctgggtgacacagtgagacgcttgtctcaaaaaaaaaaaatactaaagagacattactaaacgtctctctaggattcgcctcctgaatttcctttgtgtgtgtattcacagtccctggcctcctgaattcctttgtgtgtgtgttcacagtctatggactgctgaattcctttgtgtatgtgttcagcctctggcctgctgaattcttttgtgtgtgtgttcacagtctctggcctgctgaattcctttgtgtgtgtgttcacagtctctggcctgctgaattccctttgtgtatgtgttcagtctttggcctgctgaattcctttgtgtgtgtgttcagttttctggaaggtttccctcaaaagagtgcttgtttggggcctcttggtgtatctcatttgtctctctctgtacctgctgcaccaggcagtgtctggctgttttggggtcaggacttaatagagtacctcggaagtttctcccagttacaggaccaggcactgccccttcctttctatactgctctggaccattggccacagaaccgtttctgtgctcagacgcctcacctccctctcctcaccatacttagatggatgccccggctcggctgcagagcagtctgcctctgtggggttctaataaatcctgaaagaagccagcaaggctctggaagcctcaggacagtggctttgctggaagtctcccttcttaggattgcttcttgtttagagcttttattttgttgcagtattgatgataatttaattgaaatttaatttttaattttcctctaatgtttagggtgccaagctgttctacctttctggaatggtgcatggagaatatcaaaaccaagaaatccacaatctgggccgttttattacagttatgaagtttaggcctctcacatggcaaacttctcacccttatatcctggcagacaggtaaaatatgattttaagctttttcttcctgggccatatatttcaaagctaaaaaggctagaaaaagaacagtgataggatttattttgtgccgatttgaataggggggatagaagtgtagttgatggaaaatgtctacttatatcattgctcaaagatgccgtgcctttgggagtaaattaattatgagatgttaaggaaaatgggagaacttggaagtatttaaggctacaggatgtggccccatcctacgttcagcctcagttttcagtgatgctgccttcatgcccgggtgcttgagtccttcgtgtgtgccttctgtttccttcctttgtgctcttcctcgtgtggttttctcagcctggaattccctttttccacctgccagaatccaagccacagtaaaaatcccagagcacaggctcgccctcttccagaaagggattttctgaatatgttcttcactcttccccgaccccaggtggacgtcatctccctgtctggtgtcttatggaatgaatatcactttcagcctagagacacagttgtgtgtctgccccttttcctctggtggatggtgaatggtgcctccttatttctgcattttctagttttctaaatgacgtgcttaatggacaagagtgtgatgaatcattgacacatgaaaggaggtataggaacttttggcattcatttctgctgtgattgaatttatttttctaggatggaagatttgacaaacccagaggatatccgaacaaacatcaaatgtgaccggaaggtgtcactttatggttatttaagaggagcacacttgaaaaataaaagccaaattcacatgccaggtattctcttgttgtagaacatactagaattacacataggattcttgggatggcttcatttctcaggaaaactgaaaaatgaccaaacaagggaagatggccttgctggaggttttaaaagtaagccacctatgtgtaggcctgcaaaggtgttactgaatcccctcttctctgacctcttgtcttgtagctagggggccactgttccagtgtggcacaatgcccttctttagtgttatgggttaagcccttggactgtggatcatatttaaccccctagtcaatggtagatgcttctgacttcttgtcagctgaagctggcttttgggttctgtcttccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggtatcggtgagacgggagtcatttctctgaactttcagtattctttctgaatctattttttaatcacaaaaagtaatgtactcagcttttatttattgaagatttttctcttgtacttataataaaggcccaaatgcatattgtaaatatataggataaaaataatactttttttttcattgtaccaagcagaagagtcctctccttcattcctccttgatccatggccccagcacaggcattgctgctgtgtggcgcctgcacggcccatccccgtttctacaaaatcagtgtgctttccagctttcattggtctttttctcattcacaatggtctcctcatgctgtattttaaagtggatttcaaatatttatttctttgttctgaagtggaattttattgggttaaaatcggcttattttaaaatattagaaaagctagcattgttgtagctttggagctgaggtttttctagctaggttgtttaggttatcaggttatatactccctgaactttggaaaagtttaatggagatggggatccatttcaagctttgttgtaaggattttcttctctgctttttgaggcattaagaaaggttcttaggaaatgtgtctaagataattttgagaaactgagtgaagctcgtgtctctccaggatctttgtgctttcctcacgtgccctttcttggtggtcttgacaggatgaagtggggcccacccatgagctggtccagagtctcatctctacccactccaccattgatgccaagatggcttcaagtcgagtgacgctgttttctgattccaagccacttgggtcagaggatatagataatcaagggtaagtctgctttttttctatttttaataaaaagatgtattacaaaagatcatatcacccataattcagccatcataacacatttcggtgggattcattctatgttgttttgtttttctttgtgtgtgcatgtgtctctgagggctcttcacttacctgacattacaagggagtcttttcttgaaataaattgcaggatgcatttttcaacagaccccaaatattcctcaaataccatgccatcttccataggttgccttttgttttttaagagacctgaagccacttggctttcttttggtggccaaaacactagagcaaagtcagggagtttgtggctgtccagaagccacatgccttgtctctgaaagttttatttagattgtgttgtattatctcctctgggtaggtttccgtggatgtatggctcatgtgaattattttccagtctgggttggggatttgtatacctttatatgcagtggatgtttgcaaaacattggttttgttgtattgatttatgactcccagtaaaatttatctgaaaattttgagattatctagtatgtaatttggtacaatgtgcataaactacctagcagaatgcctgacaggtacgaagtgttcgccgaaagatcactcctttataatgggattactagctattttcacttttgcatatccttctagtcatctttgtctacaagaatactctcctctaatatagttacagttaaaatacataattttatttctatattatcatttccttctttttttttttattatactttaagttttagggtacatgtgcacaatgtgcaggttagttacatatgtatacatgtgccatgctggtgcgctgcacccactaacttgtcatctagcattaggtatatctcccaatgctatccctccccgctctgcccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgcggcaataaacatacgtttgcatgtgtctttatagcagcatgatttatagtcctttgtcatttccttcttctatacagtctttatgtagtcatcattttgttattattggtgtattcttttttttttgtgacaagatcttgctttgtctcccaggctggagtgcagtggtatgatcttggctcacttcagccttgaactcccaggctcaagtggtcctcctgcttcagccccccaagtagctgggactacaggagtgcgccaccactcctagctaatttttttttttttttctagagattaggtctcaccatgttgcccaggctggtctcaaactcctgggctcaagcaatcctcctgccttggcctcccaaagttctgggattacagatgtgagccactacccctggcctattattgctgtattctaacttacccgtctcttatggtatgattttcagttttttcaaatttatgttttcttaattttatatatcttgctacattaaatagcttcatacagttttcttttatcctgtgattttagcttcctgatgattcttctgtatcagttatagcactggtgacttaaaatggatgttcttcctctgtcattcctcctacgtttgttagctggcatttttaacaaagagctttctcttctcccctttatttcggtatcactgctgactaatgcacttgtgttttgttccatgggttattttccatcactatcattattcttcctgatgcctatgctggcccagatttggctgcaggagccttcagcctgtctcctgtgtcctttcaactgtctctgttagtctttgagcatttctcactttctgacagaacaagaggatccaggctcattttgccttctttctgctttgggcctggacttacccatttctcttaaggatcatgtgtttttagcttagaaattaatcagctttccaaaagatctacaaaacagtaacttctcttttgagcaatttttttctaaaattagatttttgttttttaagggttattcctttattctctctataagttcttttgaagtgtggtgttagggaaccatgcccgagtttgcttcttaactcttccaatgtttatcaaatcatattttccctatgctatgtcatcttaaacaattccttgacattttctatttctttgtattttcattgactatattgccatttctagattagctgattaatgtacaaattgaattattttgtatttccttggtaatacaggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggggccacagaacttcattgatgagaccagtgatatagaaaatttactcaaagaggaagaagattacaaggaagaaaataatgattccaaagaaacgtcaggtaagcttaaatgtagttggttgctgctatgaacttggctctcgaaatggtaaccaaaggaatgtctacatttaggggtctgttgattctgtgattttgttaactgttgaaaagctgcattgtggatggatctcaagggaggggagacacatgaataagcctaactggaggttggcattggtcgtttcaggtgccctcaagtggaaggaagacctttccagaaaggcagctgaggcctttctgaggcagcagcaagcagctccaaacctccgaaagcttatttatgggacaggtaaagaattctggttcagaactagaaatgttttagtttctctgattatttagatgagggaattggttggaggattcggctggtattgttgacatccataattgctgtccatcacatttcatatttgacagatgtctctaatcatcagcttatgaggaccacacattggtcttataaagtagacttatgggtttgctgtaaaacttgatgcaaataccgtccattgcatcatgttatgtcccctatttaaaagtccttcatgagaatttttttgtagattagtgccagaaaaatattcctgcccataaaaatatttatttttttcctttctgagaatgagaaccctgtataacacattttgttctcccttttgcccttgtcctctgattttatgctttactaaacttaccaatatgttctttctggtagaattaatgcaaaaataaatatatagtggtgaactttacattgtgctccctggttactgcatggtgagatcaaggccacatggtgagacatttgggctcagcccactgaattgggaaggttgttgtatactgattttcattcaggttttgtctaggtactcttagtgatgagaggctcaacactctttagagctcttctttaataatctaaagctctgcctttaaattcccttccctcccttcaccgctaatattctcactcctcggcctcttagctgctcccgtgcaggagcacaggagccccacacatgtagagcaatagcttcctggctctcttcatctgtggctgccctgccctctcaatgcctaactcttatgtggccattgccatacccaccacagacagagtccctcagttcctgagttcaaagactcatggcctaactggttgaaaatgatgagtcctctagggctgtaatttttgttctcacttttctgccatggtgtgctctttagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggtaagtctgggtagtacatttgatttattagagaattagcgaattgttctagaataagattatctgatgtcaatattgcttacctgttgttggcttcttatttttacaggattacaggtcattctcccagatattgtagtgggcgcttcatgcatcctaagcagtaacatgttctgagtttagttagaccatgtacatggcccacagaggacaggttcagctttcagtgtggacagtagtgtgcatctttattttgaaacatcacacataagtttttatacatcagatgtattttgtgtcttatcactaggatatatgtagcatccctgagttaacatttatagtttctgctatttgtaagcatagagaaatctgtgatacctgtatatgttcttcctgcagcttaccattttgtagtcacactggaattcattcagtactcaaactcaccacagcttaccctcctcttagacctcttctctttctctctctctctctttaagatatggtctttctctgcagcccaggctggagtgtagtggcacaagtgtatggctcaatgcagccacgacctcctgggctcaagggatcctcccacctcagcctccagagtagctgggactataggcacgagccaccaggcctggctaatttttgcattttttgtagagataatgtttcaccatgttgagctagtttcgaactctgggttcgaatgatcttcctgccttggaacttcccagagtgctgggattacaggagtgagccatcgcgccagcccctttctctctattctcttctggaatgttctgattttccaaaggctgctttctttttgtcaattcagtttggcttagatgtcacttctcacagaggcccaattgctatcatactgtctattgtaattcgccagataacacttaatgtactttatgagattttatttaaccatttttttatggtgaaatttaatacagatatataaaaccacgtaaaaacaattgttcagcctaatgggttgccagaaggtgaatatccctgtactcagcactcaggctgggaaatcaagctttgctgctcaattgtgacaccagccacagtccccttcctccctgtagaaggaggtgtagtccagcctcttaaggtgatgctttccttttcttcctggtttcctcctccatgcttccataagcatcatagtttacttttacttggtcttcattactgtttttcagtctatcttttaacatttttagtcaacagtctttccttcccatttctttctttggttacattttatttaataaaccaagtctttggtctgtagagtttcttgtattctggattttgtggattgctttgcatccctctggagtttcccaggccctcctgtatttcctgtgaatgggtatggagcaataccaatagaacttctgtaatgaaaggaatgtatatctgagctgtgggttgtggctacttgtggctactgagctctttaaatgtggctaatgagactggagaactaaattttaaatgttatttaatcttaattaagattaatttaaatagtcacatatttctagttaccctgtagacaaaacatctagcagttggatgggatttaaatttgatttttatttttcggcgaaactgcttcccaggtgatggtgttttctcattaggaggcgcataaagactggttgtgtccttttaatgctgttagatgttatcagttgttggtgctcaatgcctagaaccataccaatttcttaagaatgtagagtggtgatgttccattcaatcatttctctttatgtattagctgtaacacttctttaaagagaaacttttcctcttctattcggttatccactgccatatatatagggtaaatgcttgatttttttttttttttttttgagatggagtttcgctctgtcgcccaggctggagtgcagtggcacaatctcagctcactgcaagctctgcctcccgggttcatgccattctcctgcctcagcctcccgagtagctggtattacaggcgcccaccactaggcccagctaatttttttgcatttttagtagagatggggtttcaccacgttggtcaggctggtctcgaactcctgacctcctgagccacgtgcctcggcctcccaaagtgctgggattacaggtgtgagccactgcacccagcccatgcttgattttttaatcagtttgtggagtgattctccaaaggatacttgtttgtaagtttcactgtgatgtcatggatataaatgtagttgatgtgccttgtgctcctgcacctgttatcccttattgaagctcctctttatcccacctgtggcctgtaagagtctgtgcacaccagctcctgagtccttatgttacaatcatagtcattctttatcaattcttgctctatgatatgagagagcgcttggaatcacccataagaaatcctgatttcttttagtaggaaatggtatttcaacgtgacagcctaggcataggaatgctactgccatgagttggtcattacttctaggccttctcagtgacctgaaccaggagagctcatatagatatttccagttcacatacaggactacatcttactcattcttccactggagaattattccttggttgaatcagcagatgatgaaattagagaatcacataattactcatttgctttatcccatattacacacaaaatagtgtcagaataatatgactactgaaaacagttaaagatttttttcccttatatactgtctcatttctcttttcaaaagtgactgtgccattttacttacccactggcactgtaggtgggttccagtttcaccagttcttcaccagcacttgctattatctgtctttgtgattatagccatcctagagggggtgaagttgtatctcattgtagcattgacttgcattccctgatagataatgatgttgaacatcttttcatgtgcttattggctatttgtacatattcttcatattgtttgcccatttcaaaaattggattacttagttgtatgcgttgtttatatattctggatataagtcccttatcaggtacataatttgcagatatcttctcccatgttataggaattcagttttcaaacaggtttagattaacaaatagcaagaccaactttgtaaactactgtctcattgcattgccttagaaaccttaataaaattgaaaatcagttgaattagtaattatctgtttgtttacttatgaggtcagtagagtagtagtatttaatactttccctgtctgctgcttaatgtgttttatctctgtggttatactgtctccatcaaaggtaaagttattttctgggctcatttggaatgagaatatccatgaaagtgggaaatatttaaaggcaagttgtcacctactgccatttcttagagttgttttgctgagtgattggaacacctcacctaagtgctgacttttctgcgtaaggttatgaacagtatcagagattgcttcgtgactggaaagtgggaagatgataaagatgcagccaaggtcttagcagaagatggtaagtaaagagctgggttcttcaggaagactggcttctctaaactttattttcttcagtatcttagacaatagtcaaattgaaaataatagtcacttgtcaaatgctttgggaattcagacaggagtaatgaaccaggtaatattctgggttttccttttatgatgatcttattttctcagttggctgatttactgcgtatggactttaaaagtgagaaactttccataaattttaatcatgtgtttgttaaaaatagattttgtgtgatgtgaaaaatatatacaaataacatttatatttttttcataataaaggtagtatgcattgtggaaaatttcgaatgaaaagtacataacataccagaattctaccaacccataaaaaaacctttgttagcttcttcaactgtttccttctagtcatttaaaaattgtgtgtttaaacctttttagttgtactttatataatttttggcaggaggattgcttaagtgatgtactttttataaattttgtcattaaattttttcaaatatttcatttttattatttaaaattaaaaaatattttatttaaaataaataaaatattatttattattatcataccattattgaagtcacaattttttcaatatctaagtagttttatactttgttcattttataaagaactccacactgaacaactttgaaataattcttggctcacacttttttattttcataagacagattcataagtgttagaattgagtcatttttatggattgcaactgccacatggttttttggaaggtcattctttttgttttgtcttgagacaggatgtcgctctgttacccagactggagtgctatggtgtggtcatggcccactgcagcctcaacctcgcagactgaagcctcccgagtagctaggaccacaggcttgcatcactacacccagctaattttaaaatttttttgtacagacagtctttttatgtttcccaggctggtctcaaactcctaggcttaagagatactcctgcctcagcctcctgagtagcttgaaccacaaatgtataccaccatgcctggctaatttttaaatattttgtacagatgggggtcttgccatgttgcctagctggccttgaattcctgggcttaagcaatcttcccgccttagccttccaaagtgctgggattacaggcatgagccactgtgcctagtctgtagtatgtgaatgtattctttatatatatataatttttttttctgggccttctagttaatatcactgatctctgttggttcatttattattactataatttagtactctatgcagctttatcacgttactaagataccagttattaaaaccgtgtctcaacagtttccctttttgttctgctggggggcttcttttaggattctcctgactattctcaccttctcacttgcttattgttttttccataggaacttaagaatcggcttttctgttttcaaaagaaagtgtggtgggtttcttttttaatcacttcagtgaggtataattgatggtaaactacagtatttaaagtatacaatttgataagctttgatatgtgaatataccatcaccacaatcaaaataatgaacacatttgtcacccccacagttttcttacaccactttgtaactctccatcttgtcctcttccatcaccaggtacattcagctgccttgtgtcactattcagtaggttgtgccctttagaatttaattgaaatgggatcctacaatatgtactcttttctgtctaacttcttttactcagcatgattatttcaagattcatccatgctgttgcatcttcatttctttttgttggctagtgggtagtccattgtatgatgtatagcaatttatttatctgttaacctgttgataaacaattatttccaggttttggctattatgagtaaagctgctatgaatgttttttagaagtctttatgtgaaccaccgcttttatttcttttgggtaaataagtagttcagaatggactaaatgggtcatatgataggtacacatttaattttttaagaaattacccaactgttttccaaagtgtttataccattttccattgccaccataactttatgcaacttccggttgcttcactctacatctttcccagtacctgatagtatcagtctttttaaattgtaggccttcttttaggcatagagtggtatcttgtagttttagtgactaatggtatcgaacattttttcatgtgcttatttgccgtctgtgtcttctttgatgaaatatctgtccaaatcttttgtacattattttaattttgttgaattctaagaaattttgtgtatttttgatacaaattctgtatcacatgtgttatccaattatttttgcctagcgtgtgccttgtcttttctatttttaatagtgtttttcacagagcaaagtatttagttctggtgtaggtcaatttatcaaaaaaaaatttttttttttttgggatggagtcttgctctgtctcccagagtgcgatgtgatctcggctcactgcaacccctgccccctgggttcaagccattctcctgcctcagcctcctgagtaactgggattacaggcgcccgccaccacgcctgcctaatttttgtgtttttagtagagatggggtttcgccatgttggtcaggctggtcttgaactcctgacctcaggtgatccatccgcctcagcctcccaaagtgctgggattacaggcatgagccactgtgccctgcccaaaattttctcttatggactgtgcttttcatagtgcatgtaagaaatctttgcctcacccaatgtcacaaattgtctcatatattctgtaagtcttacagtttcaggttttacgtttaggtctataattctttttgagttaattttttatagagtgttgggtatggatttaggttccttttgacatattgatatctacttttccctgcaccatctgctgaaaatctatttttttccccgttgaattgccctgtattggttggccatatatgggtgaatatttctgggctctctgttctgttccattgatatatttgtttatttttgtaccaataccaacactgtctctgttacttacagctttataattagtcttggaattaagtagtttttaactttaggtagtttttcaaactttagtctccttttcaaagttgttttggttaatctaggttctttgcattttcatataaattttaagatgagcatgtcaattgctataaaaaagcccactgcaattttgattgggatttcatggaacttgtaaacaatttgggaaaattgccatcttaaccacattgagttttctgatctatgaacatagtaactctccatttatcttgttctttaatttctctcagcaaggttttcaggatacaggtcttatacaactctcaacagtttattttcatatcaacttgtatttatgtatggctaatatataagaaatgcagttgattttttttttaattgatcttatatcctgcaatcttgctaaattacttgttagttctgtttttgagacagagtctcgctctgtcacccaggctggagtgcagtggcttgatctcagctcactgcagcctctgccttccaggttcaagcaattctcatgccccagcctcgtgagtagctgagattacaggcagccattatcacgcctggctagtttttttatttttagtagaaatggggtttcaccaggttggccaggctagtctcaaactcctgacctcaagtgtgtgtttggaggggaggggtaaactttgactaaacagtattcatggttttctaagtaaatacttcttactatcccaaggattctttttcttttatgctgctttttctcctgttctgcacaataaagcctgggcttccaattctgctttgacctttcaccttggtccaatctcatatggttcccccagtttctgtgcaggatggttctgggagccaagcaggaaactatctacagaaaggctgagatagatcccagtggttttactttctttctttcctatctggatgacttaatttttcttgccttactgccctggtttaaacttccaggacagtgtggattagaagtcaaagtaaacaaccttgctttgtcctgattttgcttattttccaagtgaacttaagaatcacctttctggctgggcacagtggctgacgcctataatcctagcactttgggaggctgaggcgggcggatcacgaggtcaggagtttgagaccagcctggccaacatggtgaaaccccgtctctactaaaaatacaaaaattagccaagcgtggtggcacacgcccgtaatcctagctactcaggaggctgaggcaggagaattgcttgaacccggaaggcagaggttgcagtaagctgagatcgcgccactgtactccagcctgggcgacagcacgagactccgtctcaggaaaaaaaaaaaaaaaaaaaaaatcaccttttctatttccaaaagaaaagtttgtggtgtgttttttcctaattaaacttttaagtttgaggtaattgtagattgacatgcacgtgtaagaacaaatacagagaaaaaaaaagaacgaatacagagagatctcctgtatcttgtactatagcagtatctgtgtatatatgtactatgtatactatgtgtactgtaatacaaggtcacagcctggatgccaacattgatacaatctgttgatcctatgtagatttctccagtttcacttatgtgtgtgtgtgtgtgttttacgtgtgtgtgtgtctatacttctgtgctcttttatcacatgtgtaggtttgtgtgtctaccaacagttaagatacggagcagttccatcacaaggattgcttgtattgctgttttataaacacacccacgtccctgctgttccccagcccccagttccttcccttgtgaaccataatgtgttttctgtttctacaattttgtcatcttcaagaatgttaaataaacagaatcatacagtctataaacttttgtgaggggcttttttcactcagcataatttcctggagatccattcaagttggtgcatataccataggtcattcctttttattgctgagtagtgctccattgtatggatgtaccggtttgtttaaccattcatccaagatcaagctgggttgtttacagtttgttttgttttgttttgttttcagacagggtcttgctctgatgcccagtctggggtgcagtggtgtgatattggctcactgcagcctcgacctcctaggctcaagtgatcttcccacatcagcacccccaaggagctgggactacaggcatgcaccaccgtgcctggctaatatttttttatttgtttgtttgtttgttttgtagagacaggatcttgctgtgttgctcaggctgatcttgaactcctggcctgttttcaatttttgactattagaattgagctactatgaacacttgtatagaagtttttgtgtaaatatgcacttcccatttttctgggaaataaatgcccaataatgcaattgctgggtcatatggtaattgcacagtttcataggagactgccagagtagttgggccatttgatgtttctactagcaattatgtgagtgatccagtttctttacatccttgacaatgtgtggtgttctcactgttgtttattctagctattctaataggtatgtgatatttcattgtggttttaagatatacttccccagtggctaataatggtgagcattttttcatgtgtttatttgcatttttatatcttctatacagataaaaaatgtctggggatgtcttttttttgcacttttaaaaattgggttgggttgggtactgtgagttcattatatgtttaactccatcgtcggatgtgtgatttgcagatactttctcctaatctgtagttttcattttcttaacggggcctttcacagagcagaagtttttattttttatttatttatttatttatttattattattattatttgttttttgagacagagtctctctctgttgcccaggctggagtgcagtggcgcgatctccactcactgcaagctctgtcccccgggttcatgccattctcctgcctcagcctcccgagtagctgggactacaggcgcccaccaccacatccggctaatttttttgtatttttagtagagacggggtttcacagtgtttgccaggatggtctccatctcctgacctcgtgatccgccttacttggcctcccaaagtgctgggattacaggcgtgagccaccgtgtcgggccaaaagtttttatttttgatgaaatccgatttaccagttttttatagtattttttgttttctctttacacccatgatctattttgattttttcattttatgagatatgaggcttagctcaaggtttatattttcgcctgcaattgtataatttttctagcaccacttattttattgaattgcttttgacttttgtaaaacattagttgagcatctttctgtgaatctgtttctgggttctcttgtgttctattgacttcacatgtcaatcccttggccagtaccacccttgctgtctacgttcctgtagctttatagtgagtgttaatgttgagtagagtgactcctcttactttattcttgtttttcaagattggttaagctatcccaaggcttgtgactttccctataaattttagaataaacttgtttatgtctacaacaacttacctgggattttggtagggattgcattaaacctatagatcagtttggggggataatctttttctattttgagtattaaaatagatgaacacagtatatttatttattttagtttttatttctttcatcagtattatgattttcagcataccagttgggaatatgttttgataagtttagacctaagtatttgattttgattgattttcatttgtttctcttttgtcctgctaaactcacttattagttgtaggagggttttgttttgttttgtctttgtagattgcctgggattgtctacacagacagttgtgtagaaaacatagagacagtgttatttctttcttttcaacctgtatggcttttccttcttttttttttaattaaattttttaggggtagtgatggggtctcactatgttgctcaggctggtctcaaactcctgaatgccagtgatctgcctgcctcagcctcccagagtgctgggattataggcgtgagcgaccatgcctggccttctttctgttttaaaattttctgccttaattcagtgactagacttttagtacaatgtggagtaagagtgctgagagtggacttcctatgttgttcccaatcttgtcactgttatttatttactaacatgattggatgttgaattttgtctaatgccttttggtgtcagttgatatgatcatctggatatgggtttcattctttactcttttgatatagattacactgatccttttattttttgagacatggtcttcctctgtcacccaggctggagtgcagtggtgcgatcatggctcaccacagcatcgacctcctatgctccagtgatcctcctgcctccacctcccacgtagctgggactacaagtgtgtgctatcatgtctggctaattttttttttttttttttttttgtagagccaggtcttactgtgttgcccaggctggtcttggcttcaagggaactcttggcttcaagggatcctcccacttcagcctcccaagcgttaggtttacaggcaggagccaccgcacctggcctgattcattttttgaatgttgaagcagacttgcatacctggaataactctcacttgatcatgaatgaaaatgaaaatacaacatatggaaatgtgtgtgtttttttgttttgttttttcctttcatgtcagatggttaatgtgctaatgttgtaacaagggtcaagggtggcatatcccacatacatgcatgaatacccagtcatcacacttatgaactacgaaaagatcaccatgtgaaaatttttatacaaatctttttatgtgttgttggattccatttatagtactttgttgaggactttttgcattcatgagagatactggtctgtgagtttttttgttttgttttgttttttctttttgtggtggtactgtcttcatctggttttggcattgggataatactagcctcataaaatgagttgcaaagtgtcccctattctgttttctggaagagtttgtatagaattgggatgaattctttaaatatttggtgtaattctccagtgaaatcatctgggcctggagatttcttattccagaagctcttaattacaaattttatttctttaatggttataggacgattcagattatctatttcatcttgcctgaattttggtagtttatgattttcaaggtgtttcaagtcttgttagggaagtggaagttgcactgagtgccttcttgaagagaccagcttgggtagtctgagggtgatgtttagagtatttgcttaatactctttaacggctgcaggagcctttttgataacccctgttttattcgtgatgttgttggtttgtgtcttctctgtttttatctttgtcgtaaaatttattaattttgttgattctattcaaatgaccagctttttgtttcattgattttctctgtttttctgctttcaatgttattgatttctgccctttatttattattattattttttttttgagactgagtttcactcttcttgcccaggctggagtgcagtggcacgttcttggctccccgcaacctccacctccgggttcaagtgattctcctgcctcagcttcccaagtagctgggattacaggcatgcacccccacgcacagctaattttttgtatttttagtagagacagggtttctccctgttggtcaggctgttctcaagctcccaacctcagttgatccacctgccttggcctcccaaagtgctgggaatacaggcatgagccaccacatccggccaatttctgccccttattatttctattcttctgcttgtttggggtttattttgttctttttgaaatttcttaggttattggtttatcttttctcatttctaatgtgagcatttagtgtttaaatttccttctcagtactgctgagctgtaccccacaaatgttcacgtgttgtattttctttttcttttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcacgtgttgtattttcattcatatttcctttgggacttctttttggcccatgcattatttataaatatgttgttttaattatcaagtatttagagagtttcctgtttttctgttatagatttctagcttgattatattatgttctgagaacatattcttatgagttgaattattttagatttgctgtgatttcttttattgccccaaatgtacttcatcttggtagatttctattgactttaaaaatgtgtgtattttgctgttggagagtagggtgttatacggatgtcagattttgctggctcactgttcagatcttttgtaaatccttgctccttttctgcctagtttcactctgtcacttacgctagagtgcggtggcatgaacatgactcactgcagccttgacctcctaggctcaagcagttatcctggcttaacctcctgaatagctggtactataggtgtgtgccgccacacttggctaaattcaaaattttttggagagacaaagccttgctatgttgcccaggctggaactcctggcctcaagctatcctttgtctttgcctcccagagtgctgggattacaggcatgagccactgtgcccggcctccgcctagttttaacagttgctgagaggagggtgttgaagtagatgtcttcttggtgggttaatccttttgtcattaagcagatgttacggtcacttccttttcaccccattggtgaaggaggggtccctgccctaaagtgtaggagatggctgaacacgacacctggcgtggatggatgagactgacagcagtgttttagtcacatatacccacagctcagaggaggacactgcatgccacgcagggtcagatgggcaccatactctgtagtggagtgagggctgggggctgaggaaggaggcaggcttggtagtaacaagagcacacaatgaccaatggttcctgagggggaatgcaattggcttgtttgaataaattcatgggctggcagacaggtgaagtgaaacttcttaggctgaggtgcaaccgttctggctgataaaagaactagccaggtggggagcctttgctgctgggtggcggggtagggggtgtctggtagaaacaggaaaacccacggctaggcctttggggccctgtgaggctcaaagatgtccaggcagcataggaaattttagatcttaaaattcagcgaagaccctctccagctctggtaaattattttgcttgaagtctacttcatgagatattaatatattcactcctgcttccttaaaaaattaatgattacataggatatctttctccattcttttactttcagcctacttaggtccttaagtgagtttgaagtttcttatgaacagtatttagttgggccatgtgtttattataggctctccatccatccgtcttttggtttatttagaccatttacatttaaggtgcttattgttacataattgcttatgtctgatgtttttattatttgcttttttgtttcctttttctttccctccatcttgatctatttctgtataatgttgttgcgtgtatctctttgtatagtcttgaagtgtttgctctggatgttacaatatgcatattgtaatatagtagtctactggtaccagtatttaccacttcaaagtgtggaaacctgccttgcatttatgtctctttaccttttccgcttgtatgaatcactggcttgagtattaggtggtggtatagtttttgtttcagttgtcaagtgtgattttaagaactgcggattgtctcgtgtatgtatccacatttctggtctttcctttgtccctcctcccatagtcccatattcatcccttctgcataagaactttctgtagccatttttttattttgatttttttgttttaattttttgtattgtggaaatgacagaacatatttctgtagccactttttagcatttctaaatttaccagagacaaattcctatattctcttcctctgataatgtctttatttctctcttcatttctgaagggtagtttcatgggatatagaatttgcaaccaacagtttttttgtttgttggtttggtttttttgtttgtttctttggttggttttttttaagcacttgaaaatgttgtgccacttccttctggcctccatggcatttgagttggcatgtccctacaggcattctgccatttttggtctttgtttttagttttgaaagtttaatcagtgttgctttcttttgttatactttgaggtttgctcagcttcttgaatctgtaagtttatatctttcactaaatgtgggaagcgtcaggaattagttatttgcatgcttttgcagctctggtctcctgtgggactcagataacataaatgcggggtcttttgttattgtcccacaggtccgtgcagctctgttcatttgttttcaggttattttctctctattgtttagactgggtgaattctgttgatacaggtttcagcttctctgattctctcctctgtcgtctccacttttactcaatagagcccatctagatagatttttttttaatttctgttactgtattttatatttctgtaatttccatttgattcttcttcagtttctttgctgacgttttcagttctttgtttgttgccataggatttgtagttgcttgttgaagcatatttatgctgactgttataagtgatgagtcagatggttccaacatctgcctatgtaatttttttatttttgcaggcagtcctcctatttgggtttagtctgtaggtcctggtctactttgtgggctgtgattccaatggcaatttaatttcagagccttcatggtgttattttggtctgtttggcttatatgtatcactgggattctcccaccagtccctgctgttgcccacctgagggaacaggggagctgccccaggctgggccacctgctgcagctaggtgggtggggagtggtggttgtcttggtgtgtggagctggttttcttgttatggggaagatttcctttgatctggggggactgagtctgcctgggttgccttctattgctacgttgggagttgggaaactctgggcctggtcaacttcctattggatgaggtccagggagacacctggccactatgcattccctagtcctagagtccctcagcagcctttttctttccacctttcagaattctcctttgatcatctcctgtctattatttcttaggagggtataatgtgttatcttctctagaccagaaatccttaatggtggtttcaggttgtaactgtgctaaagggagaattggcgtatttttgatgttgagtctttcttttcaaatgaggacatatcattattcagtagataatatttacaacacctacttccttgggttgaagaatgtggttaaggcaaggaaagtacttaacacagtgcctggtgtggagagcaccgatgagtgttggtggtgatgctattccttttgtcctttggtagcatattaaagcttttcttcttttttaaaaaaataaagttctggtgcatttcttgttaggtttattcctattttatccttttttgcttttattacaaataggagcttcctatctattataacttctacctggttctttggcccttatgtgaaaatgttttaatagccttctaaacattgctctcccaaatgagttttaacttgcctatttcttttattttcctttttttgagacagggtctcactctgtcacccaggctggagttcagtgatgcaattatggctcactgcaacgtctgcctcccgggcccccaaagtgctgggtttacaggcgtgagccactgcacccagccttacttgtctgtttcttttaagagtgggaactataattgagcccagagctccaaaaacaaatgaaggaatgaatgagtgaataagctcttcccatgggtttggtgtggtttggggctctactcttaatctaaatgctatgttttatataacctaaaatttcccctaggtgtgttacacgattgtgttgtgttgaacttacattgagactccttttcacatgtgctggtatcagcgtggagcttttctattcattccttgaactattcgtttgggggacacacatagacctctgtgtctttcataaagagtgtccattggccaggtgcagtggctcatggctgtaatcccagcactttgggaggctgaggagggcagatcacgaggtcaggagttcgagaccagcctggccaattggtgaaatcccatctttactaaaaatacaaaaattagccaggcttggtggcgggtgcctataatcccagctactcgggagactgaggcagtagaattgcttgaacccgggaggcggaggttgcagtgagctgagatcatgccactgcactccagcttgggtgacagagtgagactctgtctccaaaaataaaaaacaaaaacaaaagagtgtccattgtgtatactggaaaaattgagattgggattttgatgtgaagtgcggaaatgtggattgggtccatttagtttacctaaacagatgatgaaatactaactgttttacaaagcattccctagtgcaaagttttgcctgtgtgtgtagtgacaggaacagtgagaatgaggcttggaacgcagagcacactgtgggcctgtggtaggtggggccagcagcacatgcatacctggctcacagagcagcctttgggtgttcttttcccagaggagctctacggtgactttgaagacttggaaacaggggacgtgcacaagggaaaatcaggccccaatactcaggtatgactttgtcgtagctggctgttcttggtcattgtgttctgagagaggcccacattgagaaatgcaaatcttacttgtgatgtgtgaagattgcagactggatagatagattccttcctaaagggtggggatgtggggaccaaagagaagctttcttgtttacttgttaagttttggatgacagttactaccgtttcttgccatagtcatttgccaagtccactgtgatttttcactcacggaagtcttagcttcttggacttacattcaaccattggcatcattctcctttttttaaatttaagtgtcatttaaaagaatgaagtccctgttctccctagtatttctttagaacagggtctgggagcatctgggtgagggacacgtctgttatttttattctagtttgtgttcccagccagcttaaggattagcagctaattgtaatgcagatgtaaccatttcctgtagcagtaccatgttattcagagacaaaggttgtgttgtgttttcttttgttttattgataatgataacagatttttgctaagattcttgtttaaatagaactttaaaaaagctaatgtttaaagaaaagaccttcataaacatacacaaaattttttcttctggaaatttaagaatgaagatatagagaaagaagttaaggaagaaattgaccccgacgaagaagaaagtgccaagaaaaagcatttggataagaagagaaaattgaaggagatgtttgatgcagaatatgatgaaggagaaagcacatattttgatgatcttaaaggagaaatgcagaaacaagcacaggtgagaaacctcagttcctctcagccccttgtcaagactatcatatagcgcaggaatccctgactttgtttgggtccctacgtcctatcctgcttctgtgtatcctgcttctgtgcctttcattcggactcctgggtagagatgcatgtgagtgtgtttattcatgcagtgagctcattgtttctgcagtcagagggtcaccagaaaaagatccatacctattttgtaacaagaattaggaaacagaaatgactgagacatggtctctacttttgagacatggtcttacaatgtagtgatctgagacagtgtgttcatttcagtgcaagcattggcggcctattccaatcgctgctccctgatttgaatggcaggtgatcagtggcccctgtggcttatagacacaccagagctcccaggggaagtgctctgaaaactcatcctggtcagagttcagaaggacatgtggagtataaggtcagatgcagaaataaagggagatggtgtggccctcctgcctggggatgctgagcaggttgctggaggcggtgatctcactctgaaggagacagacacagaaacgtgtgtacagttgatggtgagcatctgagttgcgtcttgttagtgaggccaggagtgcctgtgtaagctggaacagattaggtatatgatttgtgaaacggagtttcatcctaggtcttcatctagtcaaaggactatttcctgattaggcattagcttagtggttgctagtctgtgttgacctttgaaaggcatgactaggctaactctgaagtttttgcttcacaccatttacaatttaaaattacctagagccttgtgggccattggaaaagactgaatgtttcactctgaaatgggagtccttggagggttttgagcagaggagaggtaatcagatcactctgccaagagatcagtcgggtggcacaaaccagaaggctggcagtggagatgagagaaagagtcaaacccggatagactttatttggaagctgggtcagtaggatttcctggtggactgaatgtggggtgtgtgagaggaaatgaggatgtcgactggaagttcctggaaggacgggttgttgtaagttagataggaaaccctctgcagatgcagttttgggaagatgatgtttggttcggctgggtatcatgcagacaagtgaaatgtcaggtctggagagaggtctggccagggacttagatgtagatgccctcagcatgtagatgccacttaacgctgtgaggtggccgggagtgagtgcagagtgagtgggaggagcaagactggcatgggcgagatggggcgattgtggccgtgagtcctgagcagtgcctaggagggagaagcagtgtgagcatgcaggcacacaggaggccagttgtacatggaggcgaagcattgttcagatcctgctgccatgttaactacggtgaaggcagagttcaccactggaggagtccttcagcgtggaggccttcagcaatcttggcaagcaccaattttcatggatgtaggagaatgggagcagaggaactggaggctgcaactgcagaaaacttttgtggggttttgctgcagagagaagcagagaaatgaagccgttgttggtggaagaagtggaatcaaaaggttttgagataagagagagaacagagggaagagctgttggaataaagtccaggaagagtggatggtgtctagtgagcaagtgatgtgtggccctgagtagaggcatggacaaatattctgtgcctgagctgcctgtagaactttctgtgatcatcgagatgcacgtcagtgcttcccaatattgtaacactggccgcaggttgatatggaccacttccagtgtgactagtgtgattgaggaactgcattttaaatattatgtaattgtaattaattttaatgtaaatagccactcatagctcccctatgggccaggtcagagctctgataaggctggatatgggaggaaaccctggtagagggctgaccgtggaggttcttttggttttggagtgaatcaggaaacagccatcagctgagtgaaggtgagggtggtggtgggtgtttgaagacaagggaaaagtgtgaaagaattgttcagaaaggaaagaaagaagatgtggactggggacgtttccagtgttcgggcatgcagggctccacagttatctacatttgctgtcccttggagcaggagagaagaaaacggttgggacatattctgagcagactgtagaggtaaaatatgtaggtctttttttttggttttttgttttttgagatggaatctcgctctattgcccaggctggagtgcagtggcacgatctcgactcactgcaacctccgtctcccgggttcaagcaattctctcacctctgcctcctgagtagctgggactacaggcacgcaccaccacgcccagctgattttggtatttttagtagagacggggtttcaccatgttggcgaggctggtttcaaactcctgacctcatgtgatctgcccacctcggcctcccaaagtgctgggattacaggcgtgagccactgtacctggccaaatgtgtagtatttttaatagggtaaagcctacataattctgtccacagttcctttacttagaaattgctcatttgttcatgttaatcttatgtttattacagataacagcatacaggtttttttattccccatcatgtacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcaggtgggtccctttgctacatatttggtgcctgaggctctgtggatttcccctccatcaatcatcttaccctctcgtcccctcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggtaaaatatgattacaataacttgcctgttgccaagattaaaccttacaggctgcgttattatagctttgtgcttttctttcataaaattccactcctaagatttttctcttttctgggagcggggaggtggtttggagtatatatgtaaatctatatccaaatctaaatgtccatatccagtatgttaaactagaatctaaaatttgtggttcgctatatttctttttttccttttcctttaaggccctatcactccacagggaactggtttcttggcaatacagtctgtcagtggcataatggtaactatcttggatgatttcttttacagattggtttgagaaatatatcctgggtgtgggttattatgtacatgagactttaagttgaaaattactcatttttattaatacaaagtaaatttccctttgcttttaatcttcctacatcgttttcagtagggtgtgggattagaggaggggaggtggaagaattataatggtacatttcctatttttgtgcatcttttgcatttatttatctaagcaagtacttaagcagtgctcaccatgtgctaagcactatatgaggttgtgaggagccatcagagactccctgcagccgtgcagggagtccattttcatttgaccagtcaggcagggcagggtttattggtcccatttaacagagaagaaagcagaataatgagcagatggaatctgccctggagttccaaattttaatttcctaaacattgcaactgtatttttcttttccatttcattccaaataaatcattatagtgaaattacattcctctgaaatcactctcaggaaagtactcaaggcgccttttttttttttttttttttttttttttgagacagagtctcactctgtcatccaggctggagtgcagtggcacgatcttggctcactgcaacctctgcctcctgggtttaagcggttctcctgccttagcttcctgagtagctgggattacaggtgtgcaccatcatgctgagctaatttttgtatttttagtagagatgggattttgccatgttggccagactggtcttgaacttctgacctcaggtgatccacccgccttggcctcccaaagtgctgggattacaggtatgagccactgtgctcggcctcaagtcacccttgttagtttggcttaccaactttaaagttttggattgcttttgtcaaaccactgggttgcaagttcacatggtctctcttgtttttcttagctaattgtaagtaaaattcactttggtaatttattgtgtcacatagaattgaagtttttctcttgctgatattattcctattttcaaattttggggttcctgttagcctgattttcggatagctgctacaggagttgtccttgatctggataaatccataaaaattgtgaagaaattaaagctaactggttttccatataaaattttcaagaacacttcatttattaaggtctgtatatctatatattctcatatttataaatgtccatattgtttgagaaaaggaatgaaatacctttaaaatatgggcctcatatttttataaaagtgtttgaaatcttttataaacttcatattttgtttgctcctttatattctgtgttacttaaatatgctctaaaaagcagtggtaaaacagctatttaggaattgaggctgttattcataacttccatgtgagactgccacatattgaactcatattgaactcatattgaaaatatgtcattttatccactgggttttgtttcctactttttttatttgtgttaagaaagggaaaaaaatcacaagtttgtctaaccattcagtagaaaaatcgacaaagcatttgcagacaacttggcaaggttacagagaaacggatatactgtttttcagtatttggggaggttggtttgagcagcatttattgagaatttcattagtggggatgtttctattgaaaacacagagttagaaagtcataaaatgttcttgcaatataaggtaataataccaccagcgtttatcttactgttttcatgttctaagtgcatgcacctgagtaaaagcatctgggctgcagtccagtctgagagatgccaggaaaggctgcctaggccagttcagtccagtaaatccctcttcgatcttctcttccacacagacagcggtgatgagcatgcccatgaactgacatgattattttggggaaaatgaaagacttgtattctttttgagatagtaattccactttcaggggcgaatacattttgtttattttatcacccttcagtgagttgtttttgttctttaatcaaggatgtatgtttgaagtaagaagtaaagcataaagtatatgattttgtgtgtgtgtgtttttatcttgctatacctgtagggaatgtttaattctgccttggaagtggccaaatttgaaggtgctgtgattcgaacagtcagtgggataagggggcagatcaagaaagcactccgagctccagaaggagctttcagggccagctttgaggataagctgctgatgagcggtgagtgtcttgagtagtgttcagggcagggtgttaccattcatgcttgacttctagccagtgtgacgagaggctggagtcaggtctctagagagttgagcagctccagccttagatctcccagtcttatgggtgtgcccattcgctttgtgtctgcagtcccctggccacacccagtaacagttctgtgatctatgagaatagtttccttagcgagcttttccttcaaatactttgcagccaggtagagaagtttggagtgaaggttttattctttgtttcttcgcaatatggatatgaatcttcttttgaaaatgttaaagtaaattacctctcttttcagatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcgtcagactaaaggcgaacaaggactctctgtataaggtactggtcgcgtgtgtgttagtggagatgaagcctgtgctctacagacagggagtcacacagacacttttctataatttcttacatgctttgaatgttcaagtataaagtctaacgttaaatttgattgaacagttgtatatttgtggaatattttggaatggaacaccaaaaaatgataatagtggttctttctggattgaagacaaacttttcttttttaaaataaattttattttatatatttgaggttgaccacatgatcttaaaggatacatatagatagtaaactggttactatcgtgaagcaaattaacatagctaccatttcacacagttagatttttttgtgtgtaacaggaacagctaaaatctacttacttaacaaaaatcccaaagacaatacatttttattaactatagccctcatgatatacactagatctctaacttgttcatcctacatgtctgctactttgtattgttttaatatacatctccccatttcctattggtcatttcctatttggcccatttttcaactgggttgtttttctgctattaagttgtaagagttctttactgatttttggatattaacactttatcagatatgtggtttgcaaatatttctcccagtctataggttcccttttcattttgttggttgttcctttgctgtgcaggagctttttagtttgatgcagtcctccttgtttatgtttacatttgtagcctggcttgtggtgcgatatccaaaaaattattgctaaggccaacgtcaagaggctttctccctatgttttcttctaggagttttatggtttcaggtcttatttgggtcttgggtcttgtatctattttgagttgatttttgtgtatggtgtatgatcagggtccaattttattcttttgcatgtgaaaatccagttttcccagcactattattgaagagactgtcttttttaccattgtgttgtcttgtttgcccttatcaaaaattagttgacagtatatgtttggatttatttcaaaggtctctgttctgttccattggtctatttttttgtttttatgccagcaccatactgttttgattactatagctttgtaatacaattttaaatcaagaggtgcgatgcctccaactttttctttcacagtaatctcttggctgtttggggttttttgtggttccatatgagtttcaggattgttttttcttttattttctttttttttgaggcaaagtctcactctgtcgcccaagctgtagtgcagtggcataatctcggctcactgaaacctctgcctcctggattcaagcaattctcctgcctcagcctcccaagtagctgggactacaggcacgtgccactatgcccagccaatttttgtggttttagtagagacagggtttcactatgtttgctgggctggtctccaactcctgaccttgtgatctgcccgctgtggtctctcaaagtgctggaattacaggcatgagccactgcgcctggccaggattgttttattctgttctgtgaagaatgccaacagaactttgatgaggattgtgttaaatctgtatatttgctttgggtagcgtgaacattttaacaatattaattcttctgatccataaacataggatgtctttccatttgttcatgtctaaatttctttcatcaatgttttatggttttcaagtgtacacatctctcaccttcttggttaagtttattcctaagtttttgtttttctttgctgctattgtaaattagattattttcttgatttgtcacctaggttatttgcatacagaaatgcaactgatttttatatattgagtttataccttgcagcttaactgaattgatttagtagttctcacacttttttgtggaatctttggagttttttatgtaaaggatcttgtcatctgcaaatagagataattttacttctttaatttagttgccttttttttctcatctgattgctcttgcaagtactctattgaataaaagtgatgaagctggccatccctatcttgtattcaatcttagtggaaaagcttttagttgttccccactaactattatgtagactgtgggtttttcataaatgggctttattacgttgaggaactttccttctatacataaactgttaagaggttttatcaagaaaggttgctaaactttgttaaatgctttttctgcatcaattgaggtgaacatgtcgttttatctttcattttgttaatgtgatatatcacattgattgatttacatatgttaaaccagccttgcatgccagggataaatcccacttaaacacgatgtataaagtttttgatgtgttgttgaattctatttgctaaaatttttttaggatgtttgcatcagtgcttaatttattggagaagttgacctgtagtttttgtttgttgtgtgtgtgtgtgtgtgtgtgtgtgtgtgtgtgtgtgtgtgttttggtttggcttaggtattaaggtgatactggcctggtaaaatgtgtttggaattatttcctcttgctctatttttgcgaagagtttaagaagtaaactcccaggggatgggagtgactctggacatgggagtgacataatagtgactctggaccctacagtggtgggacacagcagcatctcagtctctacgaggccaggcgcagcatcagcaaggaccccagaatgatggagcactactgtggcttgggccctcgggggcagggaccagtgcagcaactacttctctccctggggaggcaggtgcctgggcaactcagattctccagggctagtccagttccaaggaagcagggttctacagttgtttgtcctgaagggcaaggtaccccagttcaaccaatgccattttcctgggacgtgggggtgccatgttggctcatccctggcaggtgtggctgctcagctcagccaagacactgattccctgtgaagcaggacagtgcttcagctcttgtgcagtggggagtgtgactgctcagactggccaaggcactgattccctggaaagcagggcaccaagtcaactcaggctccaaggggcagggcgcaatggcagctgggaggggaggggcacggcagcgtggccccgcagggtggggtgcatgctgtgatgtggacatcgtttgttcccaccagcactcatgttgaaatttgattccaaatgtggtggtgtgggaggtggggcctagtgggaggtatttgggtcacagggcagatcctttatgaatagattaatgccttttcatgggactggattagttaccaggagtggattgttaccagagtgagttcagcttcctagactctcgtgtttcctctcttgccatgtgagccccttgcatacacctgtttccccttccactttccccatgaggtgaagcagcacaagaccctcgccagatgtgctgcctgatctcagacttttcagacacaagcagggtgagccaaataaaccttttttataaaataagttaccgagtctcaggtattctgttacagccacactaaatggcctgagacagtgtaacagcagctcagtgtaacagtggcccaccggccactaggtgggggtgatatagagcaacaaagcctgaggatggaagaagggtgtggtggctgctcaccctgggtgggacatgctcccgaagtgattccaggtccaggagggcacgttgcagcagcagctggtccatgggggtggggcacaacgtcagttccttctctgaggggagtgctggggctgctgggcccctcttgcttccttatccccacagggagacatcccctctgcttcaggctgatccctctgggggatgggtggtggggggcagatatttccttctctcctttatgtgaccatcctagttttctgtgctctactagatttctgctactccttgatgcactctggggctctcctttagtgactttcatcaaaatatagttgtttgctgctttggctgtctttgtcaggggatgagcgcaaggggctattgatcggccccttgctggcatcactccctcttaaacttttcactgggtactcttttgaactatttttttccccaccatatacatgtatttttaaaacattaatgtgctaatttctattaaagcaatgtggatttttctgaaagttttaatgttttaataagctttttattgaaatgttaatgtacatacagaagagtgcccaaatcataagtgtgcagctagatgaactgtagcacaccagctgccacgccctggaccaagcagtagcctcgccctgtggcctctcccaggcactgcctccccaacccacaaaatagctactttgccagttcctgacgtagatttgttctgcctggttttgacttttataaaatacagcacattctatttagcctggcttctttggttgagtattacagaacacatccatgttcttgtctatggcagacattgatttattgtcattgttgagttccagtatatgactgtgtcaccatttatccattgatgggtaaaatgatttcctatttttggccgttatcccacggcccttaacactaaggtctggatatgggacttgcaggtacggaggggcacacacacttctgctggaggatccctgggtagggtggagactccagggcacctgtgctctgcttcagtgtggaggcttctgtgtcgtgttctgggagcacagcggcttggcctccaccaccagcagcagcttaaagagttcctgctgttccacgtgcttgctgacaattggcctcttcagtttttttttttttattttaggttttcaatgcctgcctggacttgtgttttcatttagattttggtttcttagaactgttgttattctcttcacagcttaacaatgcatttgaaaagatttgttttcatgtggagtgttcagttttgtaataagagggttgttcaaggcatcagtctgccactctgctagaaacagaagtctcccaggcatttctttttatataaagtagttaatgaaattttgaaccgtcttacatgaatttttattaaaatacacttcaggatgtggtgcccattatccattctactcttttgtaacaagtagatttctctgaattcttgaattcaaaaacaatcggggttcctaaacaaagaatatggaatattattggggatgatgtctttaataatacatttcaagataggagaaacttgttctatatagttgactttaacaaaagcctagggcaaaactttcaatttattaacagtatttatgaggcagttaagaatttgggtcatcctccgtctccactaaaaatacaaaaaattagccaggcgtggtggcgggcgcctgtagtcccagctactcgggaggctgaggcaagagaatggcgtgaacccaggggcagaggttgcagtgagccgagatcatgccactgcactctagcctgggcgacagagcgagactccatctcaaaaaaaaaagaatttgggtcatctcaattaaatatagaatttaagattaccttgaaaattcagtgcagagtattttgccttcatctgttgtttgagtctcccttcttttagccatccttccatcagaaatagaataccaagttaaacttcttaattagaatcaggaatcaggactctttggctgctgattgaaggaagaactgtccttaaatccagagtgggccagttgtggtggctcatgcctgtaatcctagcactttgggaggccaaggcaggtggatcacctgaggtcaggagttcaagatttcaagaccagcatgaccaacatggtgaaaccccatctctactgaaaatacaaaaattagccgggcgtggtggtgtgtgcctgtagtcccagatacttgggaggctgagacaggagaattgcttgaacccaggaggtggaggttgcatgagccgagatcacggcactgctctctagcctgggcgtcaaggcaagactccatctcaaaaaaacaaaacaaaacaaaaaaaacatccagagtggttgatagtcaagacaaaaagctagattatttttgttagtctgggaaataagcacctcagtggcccaaagacaaggcctgaaatttccatgaaaagaaactgggatctattcatctgttctgttgagaccccatagttccataccatagaaatgggcacagtgggttttggggggagagttgtaagtgtaagctgtctgttcctctgtttactgagaattgtgggtgtccactgaggcagttcatatttggcagatgattgagtcctgatttctcagggccggcagactctggtgttactaatcttgtggaaaagtcaacccattgagaagattttatgcagaagttttaaatgcacattgatcataatttgaatatgtcacagtctttgtttttcttttcagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaaggtactgttgcccatgctgtactgcacgctgcgtttagataggaaaagaacactctcaatagcacacttcctgtttctactgtagtctcagttattcagggcactggaactaaagtcagaggaagagccagagtccatttccctttctttgcctggtcctgctctgccctgtgcttttcatgggggataacaggtacatggctggggaacccttctgtctcggttagctgcacacagtgtccacagaatgatgaacagaggtggtaaaggtaaaatgggatcacacctgtgtctccatgccaacaatgacttcctagcacaggatgcattttcatgcagttaatattcatttggatcgtgggttgcctctagtcttagtgcttaggatgcgagtgtgtggtgtctgagagcattctgatactcaccggcttttgtccttgtcagatccttgcactgctggatgctctgagtacggtgcatagtcagaagatgaagaaggccaaggagcagcggcacctgcacaataaagagcacttcagagccaagcagaaggaggaggaggagaagctgaagcggcagaaggacctcaggaagaagctcttcagaattcaggggcagaaggaaagaagaaaccagaagtccagtttgaagggggctgagggccaattgcagtgagcctttggactggagggactgtccctggatctgcggaggtagacagtttcaaacatcacagtttgaatgcctgtgaatgacaagtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttacttttggcttagtagttttcattagggatgaatgcctgacaattctttgtggataattatttatactaccaccttcatgaggagtcttccagaagagaaagaaatattcacttgaactctgagctcccatggaagattttagagaatagtgtgtagtgtttttgttttgttttttgtttgagtgacacacaaacctagatggtacagcctactgtgcacccaggatctatgggctcctttgatcactggcccttgtggacattttctatcttatttcatatgttctgcacattagtatagtgacaaggtaacagtaagtacttttttaaagctttagacttaggagattattgtctcaggtgcagagaccaaggaaatcgtatgtatcagtgagataggcttcccgtattatgctcatgcgttatacctgcctagctacattgcctttttttaaattaaacattatgttgaagtaatcatactattacataggcgatgtatgtattttatgattgtatgttgatatagttatggggaatctattcctatacgatgtaatcatagattcacatatagttgtatattttgcccaatttctctcagtggtaatgtttcacacatataacaatcaggatgttgacatcaatacagcccgctgattttattcacatttccccagctttactttccccaacgtatactcctccatgtatgcatgggtgtgtagaaatatggaacgcagctgggcacagtgactcacgcctgtaatcccagcactttgggatgctaaggcaggaggatcacttgagcccaggaatttgagaccaacttgggcaacatggcaaaacctcatcgctacaaaaaataaaaaattcgccaggtgtggtgggtgcacacctgtagttccagctgcttgggaggctgaggtaggaggatcacttgagcttgggaggttgaggctgcagtgagccatgatagcaccactgcactccagcctgggcgacagggcaagaccctgtttcaaaaaaaaaaaattatacatatatgtatgtagaacacttcatgaatttgtgtgtcatctgtgcatggggcccatgctgacctctgtgttgtgccagttatagtatgtgtgctgctgatatgagtgccacattgcctttacaacatcataggggccaaagagggttggcaggattatgagcagttggcctagtctgagaggctctctaaaagcctaaagtctgtaggcaggtgctcagctttgtatctccataagaagggaagaggatgtgaggatcctgtcagggctaggtccacctgggaagtgacaattggaacactcccagacctctctgggcaactctgggtgtacattttcctctgttcctcaagagctattatgaatttcatcatccattatgctgataggcctggggactgacacatagtaagcccataacaattataatttaaaactaatttgttatatagcataattgatatattttaaaatgcaaaactataattcaactaaaatatacaaggcactcaagtcataccatgttttaagtagcttacaaggtgatcagcaagtgtcttatacaacaagcaaatttgttcaaagagaagcattgcaaataagtatttataattgtatagttttatattttagccagaagagtggaatcctttagcaatgggggaaataaaagaatgtttaattacagttgcagataattgccttttccaaagacaatgtatgtaggcagaactcatacctgttaatattaaaaatcttggtttatcatatttggagaacaagggaaataaaaagtttgcatattaagattatttaaactaaagttaaggaatctctaatgtctgaaagaaacaataaatagcatttttcatgtagaatttttattggtgaaggttccacctggccaggttagtaaaatacagtcacacatcagttaaggatggggatatattctgagaaatgtatcattaggcaattttgtcattgtgtaaacatcatagagtgacacacaaacctagatggtacagcctactgtgcacctgggctctatggtatggcctgttgctcctaggctacaaacctgggcagcatgtgactgtactgactactgtaggcagttgtaacacagtggtaaacatttgtgtatcgaaacatagaaaaggcgtagcaaaaatacagtattgtggaaccactgccatatacgtggtccatccttgactgaacatcatgcggcatgtggctgtatgtatacacatagtttttgctgtgagtttgcatccatctcataggaagacatatatcaaaataaggaccagactggagagtgtgtaaattacttttcaatactaatggcttattaatttgatattgtcagcaagtatgttgcaaaaacaaattccaccagaatgtgagttccatgagagcaggaactgggttgttcaccttgttggcacttggagtagagccactgagcttcgtgctgcataaaattgcttggaagaaagaagggagggcattccaggtaactgaagcattgctatgcaaagtaagcatttgccctctgaaatattttaacaatgtttatagaaacctttctcaattgtattaaactttgtaaattgtaaaaattattctgttataccttttctatttactaggcacaggcagccataggtgctaggtatgttttgaaaacatattgaacctacagtgtacatatcattccatgccattaaatattcttatttaatcatagatgtgttcaggtgtgtttggtttcctatttgtggatgtactagattgttttctttttttaacaaaacctgtgaacttgctttaagtattatcatttggtgacatgcccgccatttcagaaataaatgtttgagcaaagaggaaagccaccgggtctgattcagctctctggaggctccagagcttacctcgctgatgggaaaaagagcatcgatttaattgcccttggtaccgacttctagtatctagtattttgccagactcaggtatttcttaaagccattattcagagtcttcagcaaggacattgtattttacttgtgtctccttagttttacctagtttatttcatggttttaaagtattgtacatttttataatcctttaacaagacaaaaggttgagatgttggacatttaaatgccaaaggtgttttattatgagacttagcatttcatatttggggatggtaccttatcgaaaatcagataaactttggttggatgggtatttggaggaatcttttaagtcttttcttaagcaaagtttggacactctaaaataaggttgccaactggcatgtagagagaaaaggatgtgtcatacatttagaccaggtggcctgtcctgtaaatttttttgaggggaggggtgggcttgtttttttctgtgtttcggttttttccaatttttgttttgtgataaaatatgcataataaaacttattttatcaatttttaattgtatgagtcagtggcattaccttcacagtgctgttgcagccatcttcagagcctttccatcatcctaaactgaaactttgtacccactaaactacatcttctcattccctccttcccccagcccctgcaaccaccattttgttttctgtctctgactactctagatacttttgcaaatggaatcatacaatatttgtctttttgtgtcttgtttatttcacttagcatactgtcttcaaggtgtgtccagttgcagcatgtgtcagaatttccttcccttttaaggctgaataatattcccagtgaatgtctttaccacacgttgcttatccattcatctgctgatggatgtgtgggctgttgggaataatgttgcttgaacattggtgtgtaaatatctgtgtgagtctctgctttcagttctgtgtgtaaaagtggaattgctgggtcaaatgtcattctgtgtttaattgtgtgaggaactgccacactgtatccacagttgctgtggattccttacatttcttctagcaatatgtacaagggtttcaatttctccacagcctagaccaccctcattactctgtttttttgttggttggttgattggtttcttaaaaaacaggcatcctagtgtgaagttgcatctcgttgtgatctgtatgttgggaatgactagtgatgttgagcatctttctgtgtgcttattggctatctatagaccttctttggagaaatgtctattcaagtcctttgaatcagatttttttgttgttgaattgtaggagttctttttatattctggatattcaaccgttatcagataaaccattcacaaatattttctctcattctttgggatgtcttttcactctgatagtgtcctttgatgggcaaaggttttttaattttgaagtccaatttattttttcttttgttgcctgtgcttttagtgtcatagccaagaaataaccaaattattgtttagttttttaaaagtatttatgcgattatttggctgatacctgtctctaatgattgacggcacttcttgagggtggcttttaaacatgcaaatttgatgtcactttccgaggctccttccatggcttccctttgcttctaggccgcagcccttgtccttgctgctgctctggcccctgccctcctctagggcctctcttctgctgcctccagctctggccacagtggcctttcattcgtcggtgcacttgcctggggtcctcaacacatgcagttccctctgcctggaatgcggcagctcctccgccccctcccggcctccacctcctcgctgctccttctgaggctggccctgagaccactggtcggtgcggccttccctggaccctctccgaactccccagtactcctccaaacttttctccaataaaccagtggcactcagttgtgctgtccagggacccctgggattttcacgacccctgtcggcggctgggtgaggtcaagaatgtttcatgacaataaggagatgttattgacctcttttcactggaagtgggagcgtcttgcgggggggcagcgggctgaggatgcggctgtgttaggacgtgacagctcgcacaactgaagcaccgccactttcccacaattttttttttttttttttgctttggaaaacatttctcaagaaaatatgcgacttatgttaccatgtaatgggcttgcttctgttattttaaaacaaactaataagtctcctaaatgtttctcggctttattttttgttgttatggttccttttcttctgtttcccccagctttatgaaggtgtaattgacaaacttgcatatctttactgctcacagcgtgctgttttgctgcatgtgtgccctgtggaacgcttcgtggcgctgctgcaaacctccatcacctagtgctgtgagggcccctgggatccgctctcccagctctgcgccctctaccccctgctgtgcctgaggcccccccacctccctcggacccgcgcccgccgctggaaccgcacccatggcccgcgccccgtccccgacccggctttagtttccacccacacgaagaaactcagcctcggtcctgtttaggcacggaaagggctggagaaccgcgtccttccgaggcgcccccagcgcggctccccacggcgtgcaggacccgggactgtcgcgccgcgcccggggacgcacaggaggtgggaccccggagcgaagcccctgcagcgtcccgggctggacgtggccctgcacccccggctgctgggcgggccggggcatgtacgagatcgcgcgctttacaaactgtcggtcgttctgggaaagttaaagaacgcgctgcagctacttcacctgctgctgaaaggagcccgggcagggctggtcactccgcgccacgccccgcgcgccaacaccggaaggtgaatgttcagaacatttttatcatttaaagccagtatattggctgggcacagtggctcacacctgtaatcccagctacctgggagtccgaggcaggaagatccgattgagcccaggagttccagagcaccctgggcaacatgacaagaccctatctctacaaaaaaaaaaaaaaaaaagccgagagtggtggcgcgcacctgtggtcccagcaactcgggaggctgaggcaggaggatgacctgagttcagtaggtctccagcctgggcgacagagcgagaccctgtccattaataaataaagccagtgtacctaaaataccatcacaacatggaatcagcataaaaatgattattgaactacttgacattcctgttttgtgctaagtctttgaaatttggtgtggcgttttgttttgttttgttttgttttttgagacagagtttcgctcttgttgtccgggctggagtgcaatggcacgatctcagctcactgaaacctcagcctcccaggttcaagcaattttcctgcctcagcctctggagtagctgggattacaggcgcccgcgaccacgccgggctaatttttttgtgtttttagtagagacagggtttcgtgatgttggccaggctggtctcaaacccctgacctcaggtgatccgcccacctcgacctcccaaagtgctgggaccacaggcatgagccaccgtgcccagcccagtgtgttgtactcttatagcacctctcaattcagatctaaattttgtgggaaataatctatatttagatttcacagtattcacagttgaaaaaatagatgtatatccccttgtttcaaatgtaactgaacctagtcacttgtttgaaattcaaattaattaaaattaaaaatttccagttctcggcaccagttacacatttcaagggctcaatggccccatgtggcagtggtcccgtagaggacggcacagctctagacatggtgtaggaagttggagaaggcttccttagggaagcaagtgacggttgagccatgactagaagttggttaacttggcaaaggctgggagttggggaagcagaagagtgtgtcaagcacaggaatgttatgtggaaaggcctgtgacacagggcagcatgacgcctgcaagccagcgtagctggagccaggacagcagcagagagtcctaggagctggagaggaaaatagagaggcaggggatgaggccgccttaagaggctatcttcatcccgagacaccaggaagccctgggagaacatttagctgggacagcgtggttagatttccatttttcaaaaagcccctttgctactgggtggagatagtttgcaggaagtttaggggaaggaggcacagagagggagaagtggtgggtgctagagctctgagaggtaacattggaggggtagtaggtctgggggttgtgaggaacaaggggttttcagggagtaccccagggcccccaggtgtctggctgggatgccaggtggagtgatgggcacctgtgggacagccaggcagagacatctgaggcggcagctggggaactgtctggaactccggttgatgtgctacctgggcttaagatgtactcccaagagttaccaacacctacacttgggagtgggtgcattatccagggaggagccaaggttgaacacaggtgggtttttgttcagcattttaaaaaattttcatttttttttgtagagacaaggtctcattttgttgcccaggctggcctcaagagatcctcctgccttggcctcccaaagggctgggattacaggcgtgagccactggtcccagtctgttcagcactttttccactagcttagtatctccacatacctcaaagagatcaccaagtccaactcatacatgcaaaccagtgctcaggaagtccacatgatcctgctgtggttcatttgaccaaaactgagcggtggagctaagcaaggctgtttcacagaagccagatatataagtgtcctcaatatggagggcagtcaccatctcccagtgtctctgactgctgcaggcacacttggcaaactgtgctcaggtcagggatggtctgggtgggggctccagtttctgccactcaccagtgatgtgactctgggcaatgtacaaaatctcttgggttttaagtttcttagatggggataataaaccaatcttgcagcatgtgaggatttaatgagactacagttcccatgaaggggatggggtgctgaccttcccacacagtcaaaaatccacatataggccgggtgtggtggctcacgcctgtaatcccagcactttgggaggctgaggcgggcagatcatgagttcgggagtttgagaccagcctgatcaacatggtgaaaccccgtctctactaaaaatacaaaaattagtcaggcgtggtggtgcgcacctgtaatcccagctactcaggaggctgaggcagaagaattgcttgtacccaggagatggaggttgcagtgagctgagatctcaccactgcactccagcctgagggacagagtaagactccgtctcaaaaaaaaaaaaaaaatccatatataactttcaactcaccacaacttttgttaatagcctactgttggccagaagccttaccaataacataaacactcaacacatattttgtatgtgatttgtattgtatactgtattcttacaatgaagtaagctacagaaaagaaaaagtactaataaaatcataaggaagagaatgtattcactatcactaaatggaagtggatcatcataaaggttttcatccatatcatcttcacattgagtaggctgaagaagagaagaggttggtcctgccatctcaggaatggcagaggcagaaaaggtgggggagatgggaaggaaggcaggagacgcacacatgctgagaaattcatcgttatttctgtctgacatttttgctttttcatttctctaaatatgtttctttgtgataccaatcctccttccaccatttgctttagttttggtgcccgtaccatagaaaggtccatatggtaaaagaagtcacaagcagtcttgaataatcggaacccctctgccagattgtcgaatgtcaacttattttctggtactgcgtctacatccacttcttcatcatctggcactgattcgaaagcactcatctccatcaagtggtcttctgttaattcctctggtgtgatgtctattcactcttgaatttctccaagatccatatcctgaaagcctacattccccaccttttttgccacaggcacactctctttcatgatttccttgattggccctattgtaaatctggacacagttttctccagtaggaaggctgggcactgagagccttcgaaccttctgcttcaccttttgacatttagggcccaattttaatgcatttaaatgttgcctccactctgaaatgaacatgggacgtctgtaatgtgtgaaataggtgtgtctcacccccttcatgaatattcatagagccttctataacctgttgaatatgtacatttagccaaccctttcagcataacttcctgtctcacctttctgtccctggaagtgcctacttttggtctttgctggaggctagacttcccagcctgtcaagacagccaggctgcaggctgcaacctttctaagaaataacgcttttgggctggcccagtggctcatgcctgtaatcccagcactttgggaggctgagttgggtggatcacttgagaccaggagttcgagcccagcctggccaacatggtgaaaccccatctctacctagaaaaaaatacaaaaattagccaggtgtagtggcatgtgcctgtcttcccagctaaacgggtggctgaggcaggagaattgcttgaacctgcgaggcagaggttgcagtgaactgagattgcaccactgcactccagcctggatgatagagctagactctgtcagacaaaaaaaaaaaaaagagagaaagaaagaaagaaagaagaaagaaagaaagagaaagaaagaaagaaagaaagaaagaaagaaagaaagaaagaaagaaagaaagaaagaaagaaagaaagaaaataaggctcttggcctggcacagtggctcatgcctgtaatctcagcactttagaaggtcgaggtgggaggattgcttgagctcaagagttcgagaccagctgggcaagatagtgggacccctgtctctacaaaaacaagtttgaaaattagccaggcatggtggcacacacctgtagttccagctacttgggaggctgaggtgggggattgcttgagcctgggaggttgaggctgcagttagtcatgattgtgccactgtactttagcctctccaaatttgtagatctcataattttaagtcaccatcctccaccagtctttcgttttaagttgttgtataatgatatcagtttttcttgaatcatattagaatctatagatatgcttttcttatagatatcctgcacccacataaaagctgcattttctctatttctctgtccttccttccttccttctttcttcttcttctttcccccccacccccctacagagcctcgcttccaggctggagtgcagttgtgtgatcttaggcttacttcagcctccacctcctgggctcaagtgattctcctgcctcggtctcccaaagtgctgggattaaaggcatgagccactacattcagccaaaagctacattttcaagactagacaaaaaggtatttggcaaaaagagcaaagtttcatgtctgctagcatggctgcagtgatgacactgtgaatttccttttctttttttacaatggttcttacactggattaatttatcttgaaatggtgggcaaccgcagctgcagacctcagtctacagtacatatcaatcaatccacctttttcttgtactgtcaagacttttctctgctttttggcagcacttccagaatcactagtggcgcttcgtacgcgtctcgatgtcttcttcagatttatggtattgcactaaacatgaaaaatacatgagaaccacgagagattacttttcactgtgatacacaatctacaggagagacaagtgctcacacggagatggctagtgtcacatggcattttaagtggacactcgacacctgagctcactgcaatagtagcaggaggggcgacagaattactacagtagtacagtgggctcccattaatttatgcaattatgacttaatactgcatctttacatttgtttacatttctcttgactgaatggcaccatgtactgtgtttgtgtgcataacttttgataaattttaactgtttatagttgatttatgtatgttttatggtggtaaatgataaaaatatgctagtattttatgcattcatgacacacctttttcttaactttttcaatatttctaggctacaaggttcatctgcaagtttcttcaaatggttgcaatgcttactgcaacctccatctcctaggctcaagtgatcctcctgcctcagcctcccaaagtgctgggattacaagcatgagctactacatctgtccaaaagctgcatttccaagaccaggtaaaaaggtatttggccaaaagagcaaggtttcacgtctgctggcatggctgatgtgaaattttccaatacatttttccaatatatttactgaaaaaaaaaactgggccaggtgtggtggttcatgtctgtgatcccagcaatttgggaggccaaggttgggagggttacttgagtcctggagttcgagaccagcctgagcaacatagcgagaccccgtgtctctttttttttttttttttttttgagacagagtttcactcttgttgctcagactggagtgcagtggcatgatctcggctcactgcaacctccacctcccgggttcaagtgattctcctgcctcagacttctgagtagctgggaccacaggcacgtgccaccactcccagcttttttttttttttttttttttgtatttttagtagagacgaggtttcaccatgttggccaagttgttctcaatctcctgaccttgtgatctgcccatctcggcctcccaaagtgctgggattacaggcatgagccatcacacctggccaaccccgtgtctgtttaagaagatttaatttaaaaaaaaattttttaagaaaaaatctgtatgtaggtggatccatgtagttcagacttgtgttgttcaagggtcacaattgtatctgtggtgactgatacgaaacagatgaccaaaaaatgatagttttatttccccatctggtcccatttaaaagaggtgtttaggtctgagaattttcacacgtacaaggttccacagtcaggatgccaagaagctgcacccctcttgctggagtccagccctccccacccaaccctgctgactgctgatgcgccttccatccctgtcacaccgttgtctcgggaaggttgtgtgagtggagacacacagcatgggatctttgtaactggctgctttcgctaagcatcatgtttttcagatccaccccaatgctctgtgtgtcagtggcatgttcctttcaattgtggaatggtgtttgcctgcacagggagacacaggtagttacctcttcatccatgggaggacgtgcggttgtgtccagatttaggcgattatggatagagttgctgtaaacatttgtgcagaggttttcatgtgaacacaatttttccttactccagggaaaatcgttatgggactgctgggccatgtggtttaacacaactgtcagagtgctttccagtggcacctcactatggttttgatttgcatttccctaatgactagtgttgatggtctctcataggcttgctgtcttccacatacagcgtcctcttcggtgagggtccaagtcttttacccacttttgtttggatggttttctaactgttgattttgagagttcttcatatatgtcggactactttctttgttggatatgtggtttgtagatattctctcccagcctatagctgtcttttcagcatcttttaatagtctcttttgcaaagttatattttttattttgatcaagtctaattgatggatttttgcttttacatgcatttggcatcatgtctaagaacaatttccctaacctcaagtaatgaagacttcttcctatgttttcttccaaaactttaaacactctctctctctctcagcaaatacggaggaaacattcatgacaattgcaattctggtttctgtagctggtcacgtggtcctataactaccttcttccactccccagtctgtattccctttgccttcaggaagcctctgctggttgtggtttttaacctggtggggaaccttcattcccaaaggttctggacaattattaatcctgcctagattgggctgttgtgcttttctattgatcttaatcacagcgcatgccacgagggccctcctataccccagacatgctcttccccagtccattgtgaagcagcagggcagtttctccttggtggtctggaccagccacccccaccagcgtagttaactccttctttacctgttgatccagaggcatgaagagcttggcgccatcaggtggcagcctaaacttccagcgcaatggatcatccctgtgtctcttgggggcagcattcctccctctggaactaagatctctaggccagcagagcataaggtggtggggacaaggagcaaaacttttgctagtgggtcactaggggtgatggtgagtagtgctatgctaggagtcttggctatgggaggaatagcaccatgtattggacactgattccgagcatatccagccttctgagagccttgccccagccttgaaaggcactgccaccgagctgcactgtcactgagtcctccaaaggccattattccaccatctgtcaagccagctgcctcaggacagtgggagcctggaaggccagtgaattccatgaacattgggccatcgcggcatttcttttgctgtgatgtgagttccttaaccagaagaaatgctgtgtggataccatgacagtggagaaggcgttccgtaaacccacaggtggtagtttcagcagaagcactgtactcagggagggcaaatccatatgcaaagtgtgtattccacttagaacaaatactgcccgttccatggtggaaaaggtcgtaggtaatcaacctgtcactaagtggctggctgatcactctgggagatggtgtcatactggggactcagtgttggtctctgctgctggtagactggacatattggtggctgtagagagttcggccttggtgagtgtgagtccacaatcctgagcccatgcataacctcatccctgccaccatggccactttgtttctgagaccctggggtgatgacaggggtggctggggaaagagactgacatctacagaatgggtcatcttatttacctgttattaacgtcctgctctgctgaggtcacccttcagtgagcattcacataggcacacatatcatcacattttctgccccttcagtgaggtctatccacatacctcttccccaggcttgtctgtcacacatctacctatcatgttccctgcaagtccctaaccagccagccaaattattggccacaacccatgaattggtatatataatctcacgtctggccatttctccttccaagcaaactgcacaatcaggtacactgccccaagctctgcccatggggagggttactcttcacctttgtcctttagggatatcctagaagggggctgtcatgctgcagctgtctgctttcaggtggtacctgggtatcacacagaaccatctgtaagggccaagagaaggcctgagccttctctccctctgtcatctgatcctagagaactccccatgaggccattggtgcaggctgggagagagaaggcagtgtactaggggtggggaccatgggcatttgggccacttatgcagccgacttatgccttcagggcctgctggggcctgttcacacacagacccctttcctctgatgatggagcgctgccatgcatgcccacctcatgcttcatgggtcagataaaactcagttcatgttggtcagctcaggtcacatgggaacttggtgatccccagttaagcgttcagcctagtggcagatgaacagatgtttctcaaaaggaaaatagttctccctctccctctccctctccctctcccttccctctccgtctccgtctccccacggtctccctctccctctccctctttccacactctccctctgatgctgagcagaagctggactgtactgctgccatctcggttcactgcaacctccctgcctgattctcctgcctcagcctgccgagtgcctgcgattgcaggcgagcgccgccaagcctgactggttttcctatttttttggtggagacagggtttcgctgtgttggccgggctggtctccagctcctaaccgcgagtgatccgccagcctcagcctcccgaggtgccgggattgcagacggagtctggctcactcagtgctcaatggtgcccgggctggagtgcagtggcgtgatctcggctcgctacaacctccaccacccagccgcctgccttggcctcccaaagtgccgagattgcagcctctgcccagccgccaccccgtctgggaagtgaggagcgtctctgcctggccgcccatcatctgggacgtgaggagcccctctgcccggctgcccagtctggaaagtgaggagcgtctctgcccggccgcccatcgtctgagatgtggggagcgcctctgccccgccgccccatctgggatgtgaggagcgcctctaccccaccgcgaccccgtctgggaggtgaggagcatctctgcccagccgcccagtctgagaagtgaggagaccctccgcctggcaaccgccccatctgagaagtgaggagcccctccgcccggcagccaccccatctgggaagtgaggagcgtctccgcccggcagccaccccgtccgggagggaggtgggggtcagcccctgccaggccggccgccctgtccgggagggaggtgggggggtcagccccccgcccggcagccaccccgtccgggagggaggtggggggatcagccccccgcccagccagccaccccgtccgggaggtgaggggcgcctctgcccggccacccctactgggaagtgaggagcccctctgcccagccagccgccccgaccgggagggaggtgggggggtcagccccccgcccggccagccgccccgcccgggaggtgaggggcgcctctgcccggccacccctactgggaagtgaggagcccctctgcccggccaccaccccgtctgggaggtgtacccaacagctctttgagaacgggccatgatgacaatggcggttttgtggaatagaaaggggggaaaggtggggaaaacattgagaaatcggatggttgccgtgtctgtgtagaaagaggtagacatgggagtcttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcattaagagtcatcaccactccctaatctcaaatacccagggacacaaacactgcggaaggccgcagggtcctctgcctaggaaaaccagagacctttgttcacttgtttatctgctgaccttccctccactattgtcctatgaccctgccatatccccctctgtgagaaacacccaagaatgatcaataaaataaataaataaataaataaaaaggaaaatagttatctgctgaggatggcagggctgtgcaccaaaatcttaagggcctgtgctgcgactcacctataggcgcctgccaaaggctccaaacttatctgccactgatgcttcgagcaatattggatctgctgggtcacatggtccctgtggcagagtagcatgcacggacacctggacctgctgcacggccttctcttgttctcaacaccagcagcctttcaggtcacttgttacatgagctggagcaacacacccaaatgaggaatatgcttcatcaaaactccaaatagttcaacttgcattataattcagctagccacaggatgagattctgagtttgattttcagcaatctcagctgaggggctacctgggctaagggtttacttgagggcacacaaaggagttttcaggtcatttatgtgatacttgagttgggaattggaatccctgagctcattcttttatttcccctttgtctagtgacaatagaagcaaccatctagtattcattagtttgctgaaaatgtttgaaatgccctatacacagtcacccagatcctagcttcttataaagtggttgataggagtctccaatggtgatatttgtgtatctctattgccagattatgccatgaactatcagtgctctattattggaaatagagttattaacaactttaaatgaaatctgtttagagaaccaattccagaaaccccagaacaaacccagaacactcattctcaaaattctgttcctctagaaccattatctgtaccaaaatctgtattagtcagagtttttgagaaaaacagaaccaatatgatatataatgggctcacacaattatggaggctgagaagtccagttggcagcctggagacttgggagaaccaatgatgtagttctagtctgtgttggaaggcttgagaaccaggagaactgatggttgagttccagtccaaaagtcagcaggctcaagatccaagaatagcctatgtttcagtttaagtccaaagacaggaaaagaccaatgtcccctctcaagcagtcagacaagaggagtcccctcttgctcaggctttttgttgtattcaggtcttcacttggttgaattatcctgcccacattggacagaacaatctactttactcagttcaccaatccaaatactcatctcaaggagaaacaccccacagacaaacccagaaaatgtttagccaaatatctgggcaccctgtagcccagtcaagttgacacataaaattaacaatcacagctgttgtggaattaacctaaatgtctataacgaatgaataaagaaagtgtgtgagtgtgtgtgtgtgtgtgtgtgtgtgtgtgtatacatatatataaaatatacacaatggaatattatttaaccataaaaatgacatgctgtcatttaggcaatgtggatgagcctggaggaccttatgttaagcaaaataagtcagacacggaaagatgttctcattcatatgtgggagctagaaacattttgaactcatgaaagtagagagtagaattgtgggtattagaggctagaaagggtagagaggagagaaggctgggggaggctgggtaccataccaaattacagttagataggaggaatgagttctgttcagcaacactgtagggtgaatgtggttaacaataatttattgcatattttcaaaaagctaggagagaggattttgaatgttcacaaaacaaatgaaaatgtctgaggtgatggatatgttaattatcctcatttgatcatttacacattgtatgctcatatggaaatatcactctgtatcccataaacatatagaattattacatgtcaactaaaactaaaaggaaaaaattaactatcacagagatgagccagaagctcataaacacctttttgaagtcactgtcctgaactcctcacatgctatgatttccctggtactttccagctcctaggagctctccttttcagcgctccagctgagcaagggtattatttacttcactctgcaccttgcttgtcatgaccatgcccacatccagcgtcaagcaataaaaggacagaaagagtaaaaaagcaatggagtgcacccacctgcttagaccatctctctagttatcaggaagtgaggtgccagtgggctgcaggggactggggcataagaaaatggagtaaagagaaaagagtttcttgcactctctctgcatgttaggagactgtttcctgctcctcagccagatcaggaaggcttctcctgagccctctctgtttgcacccaagtccacttccaagttcaggcgtccttgaagacagactaagagacaccaaagaagggaaatggtaaaactcaatgccagatcagtgttactttgaattatggtgttttgttttgttttgtttcccaattctcctggggttatttggttttaaaactcttcaaatagcttctttatgtattctctctgatttagtgggagggacacagtgaaacgtgcttactccattttccccaaaactgaaattcccttaatttttttgaaactaaaaatgaattcctacaaacatatgaattttttttaatgctcattgttttgaaataattatagattcacaggcagttgtgcaggagtgtacaggaaggttccttgtgccctttacccaactgccccagggctagcatctgacataactacaatatcaaaacaggaaactgacattggtacgatccacagagcttactaatattcaacgaggtagtgatgtgctcacttgggtatgcgtgcatatagctgtctgtaatgttatcaagtatgtacttgtacctatcatcacaatcaggatgcatacctctgcaccacaggcttccttatggtaccactttagaggcacacatccacacgtccttcactccatccctaacccctggcaactattaatcttctcttcatctcagtaattatgttatttcacaaatgctatatacgtggaatcatatagtatgtacctttttaaaactgacttactttttaagattgataatttatttgaggttcattcaagttgttacatgtatcagtagtttgttctttgtaatgctgggtaatattccataatatggatgtaccacaatgtatccaatcattcaccattaaaggacatctgggtagttttcagtttggggttattacaaataaagctgctatgaacatttgaatataaaattctgtctaaaaacaagtttttatttctgtactagaaatgcccatgtttgcattttcttggtcctatggtaagtacattttcagttttataaggaactgccaaactttttccagagtggctgtaccattttacattttcaccagcaagtgtgggtgctctggtttctctgcttccttgccaggatttgctgttattctgttgttgttgttgttgttgttgttgttgttgttgttgttgttgttgttggagtctccatcgcccaggctgaagtgcagtggtgtgatctcagttcactgcaacctccacctcctggtttcaagcaattctcctgcctcagcctcccaagtagttggttacaggctcataccaccacggccggctaacttttgtatttttagtagagatggggtttcaccctgttggccatgctggtctcaaactcctgatctcaaatgatccactcgcctcggcctcccaaaattctgggattacaagcctgagctactgcacccagcctagtgctaatcactttttaaaaagccattctaatatgtagtgatgtctcattgtggttttaatttgaactttcctgatggctaatgttgctgaccatcctttcatttacaaagaatattttctttggtcaaatatctgttcatgtcatttgcacatttttaatttgattacttatttattttatgttgagttctgagagttctttattcttgacacaagttctttgtcagatatgtgatttgcaaatattttctctcattctgtaacttatctttccatcatcccaacagggtcttttgcagagcaaaaaaaatttaattttgatgaggtccaatttatccattttttttcttttatgaattgtattttgatgtcaagtctaagagctctgcctagttcctggtcctgaagattttcttctatttttttcctgaaaatattacagtttgacattaagcccatgatccttgtgttatgttttgtataaaatgtgaaggtcgggccaagcctcatctctttgcctatggatgtctgattgttcctgcagcacttgttgaaagggctatcactcctctactaaactgctgttgcatttttctcaaaaattaattaagcatatttctgggtggggggtctctgttctgcaccagtaattaatgtgtctatccctccaccagcaccatactgagttgatcactgtagttatagagtaagctttaatacttggtacagtgatttcttccatttaattattctttttcaaaattgtttcagctaacctagggccactcccttttaatataaagtttacaataagtttgcatatgtatacaaaaaacaatgccaagatttagaattgtattaaacctgcaatttgggggaagctgacatctatgttgagacttcccatccctaaatatggcatgactctccatttatgtagatatttgatttctttcagcagaattttgtaatttgcactatattctcctgtatatgttttattagatttatacctacatattaatacttcatgtatttcgagcagttgtaaatggtattgcagtttttattttggtttccacttgtttattgttaccatagagagatgcaatttgtgtacgtgtgttattcttgtgtattgcagccttgatattctcactctttatatcaaggatgttttgtttattccgtgggactgtttatgtagatgattatgccacgtgcaagtagtgataattttctttctttcttttcaatctgtgtactttttatttctttttctggtcttattacactggctagaacttctagtactatcttgaattaaaatggtgaaagggaacattcctgccttgttcctgctcttaaggggaaagcattcattctttcaccattaagtgtgatgttaactgtagatttttgcaaatgctgtttatgaagttggaggaaattaccctctattccaagtttgctaagagtttatatcataaatgggttttgaattttgtcaaaaccttttcctatgtcaattgataagatcatatgatttttcttcttcagtttacaaggcagaatatgttgattggcttttcaaatattaaaacagtcttgcataacttgagtgaaattcctcttgattgtggtctactactctttttatgcattactaaatttgatttgctaacattgtcttgaggatttttccatctaagcttatgagccaaatcagcctgcagtgttctttcctctgtcccttcctccttcctccctcccttccttcctttgtgctgtctttgttttgttttgatatcaaaataatgatatcatagtcctttctcttctattttctggaagagattgtgtaaaactggtgttgattcttctttaaatatttggtaaatactccagtgaaaccatttgggtctggatacattgtgttcaggagctttttagttacaaatccaatttatataatggttataggactattcaggcttttatatatttcatcttttctgagttgtggtaatttgtgattttcaaggaattgatccattttttcctaggctgtcaaatgtatgagcataaaatttttatagcatttttcatagatgcagcctcttttgtgatatttcttgtttcattcctgatattggtgatttgtgtgttatctcctttcatctttgttgatcatgctagaggattatcagttttattaatttttttaagaacctgttttttatttccttaatgttctgcattgctttcctgtttttaatttcatcaatttctgctcttcactttccgtcctatttgccttaactttattttactattcctcttttagttttttgactactggtttgagaactttccatattactaaggaaataatataaggatttagtgctataaatttctctctcagctctgctatagctgaatccctcaattttttttttaagacagggtctcattctgtcaccgaagctggactgcagtagcacaatctccacttactgcagcctcaaccttctgggctcaagcaatccccccatctcagcctcccaagtaactgggactacaggtgcatgccaccacacctggctaattttttgcagagatagggatttcaccatgttgcccaggctagtcttgaactcctgggctgaagaagtgatccacccgccacagcctcccaaagtactgggattataggagtaagccattgcacccagccgcatccacaaattttgatatgccatattttcattgtgttacttgcgttttaaaaattccctttgagacttcttcttgtccacattgtatataaatgtttactgcttaatttccaagtgtttgcagatttttctcctgtctttctgcaatttatttctagtttgattccattgtggtcagaggacactctttgtatgatttcggtttttaaaaatttattaaggtttgttttaagatctagagtctgttctataagagcttgaaaataatgcgtattttgctgttgatggatagagttttccataaatgttaattataccctattggctaataatattgttcagttatcctatattcttgctgatttttttgtctagtaattttacaaattctgaaagtgagatgttgacatatcccaactataattatggatttttctatttcttttttaagctctatcaggttttgcttcatgtgttttgaagctgtgttgtttggtgcacatatatttaggatcaagatatactcttgctcttttgttattatgtaatattcctcttttgtcctagaaattctttttgccatgaactctatctgatattattatagcatctcctgcttttttgaaagttcctgtttgtttgcatgaaatatttttttttctgttctttcacttccaatctgttaaatacctatgccatggtattagaactgaatatcttatggacatcctataatgggtcatatttttgcatttactctgctatttctgtgtttttcccagatttaaccaaactgcaaagtctgagggcatggttcctaaaatttccctcattcctgacaccaacagcaagttttggaggtttccaaagcaccttaagtttcaatcatttgctggaaggactcattgaaaactgctctacatgtggttactgtttactgcagggaaatgatacaaatcagaaccagcacagagggcagggctaggagggtctgtgaagcctctgttgtcctcaggtgcattactctcccagcatccacgtgtgacaataccatgaagcactgccaacctaggaacctcacccaagccttggtgtccagagtgtttcctggaagtgcattgtgcagccataattgacagatctgttggagactggttggaactctgtcttcacctctccctttcccggaatctggggctgacagcacattcctaggggggcccaccatgagccagctggtagcataaacttcaggtatggtctgaggggcccactatgaatagcaaagacccttctgtcacatgggcttcaggactacttaccaggagccaggacaaaggctagacctctctttgggctaggccaaattctttaccacacagaaattatatttaggactcaaatgtgccatttttatttgctttctgcatgtttcttatgtttcctttatcctgttttgtttcacttgtcatggattagttgaacagtttttagcatttcattttgaattatttattcttttgggtgcattgctttgtatcgttttctaagtggctgctctaggattgattataatatacacatgtaacttatcacagcctgctggcatcaatgtttcaccatttcatgagaaatatcaaaagcttacttttatttccccttttcctcccccacttaaacatgtaattatcataaatatttcctcttcagatgtagagcaccgcagcagatgatgttattattttttgcttcaaccataaaatacaatttaagaaactcatcatagtctattatatttaccacatgattaccccttctgttgttgctatttctgatttccttatttcctttttgttaggagagcttccttcagccatttattaagggtgggttttctggtaacaaattatcctagttgtccttcctcttagaatgtctttatttccccctcatccctgaaggatacgttcactgaatagggttctgggcagacagtttttctcagcacctggcgatggtgtgttgcccccctctacctcgtggttttagagaagcccaccatcctcagaaccagtgtatcttaatgcatcatttttctctggtggtttaaaaaatttttttctttgtctttcctttcctgaagttccattatgatgtgtttatcctatttggggtttgctcagattcttgaatctgcaggtttatttctttcaccaaatttgggacgtcttcaaccactgtgcctttgaatactttttcaccacacattccttcctctcctcctgggactctggtgacaggaacgctgggccttttgtcactgtcccacccatccccaaggaggcattcatttctcagtctcctatctctccgttgttcctatgggccagctctattaattgtctttgaatcaacagactctgttctctgtcgcctccactctgctattgaacccaactgcacattttttcatttagttattgtatttttcagttgtatgattttcattttgttcttgtttcaagaaaattcaccattgttttctgaagcatttttatgatggctgctttaaagttctaatatctgatttatcttgattaatcttattttgctatttaagttgttttttgttttgttctgttatgtttttgagacagagtcttactctgatgctcagactggtgtgcagtagcatgatctcagctcactgcagcctcaaactgccgggctcaagcggtcctcctgcttcagcctcctaagtagctggcaccacaggtgtgtgccaccacagctggctaacttttaaattgtttgtagagacaggatcatgctgtgttgcccaggctgatctcaaactcctggactcaagccatcctcctgattgaccttccaaagtgctgggattacaggtgggagccccctcacctggcttcaagttgctttttatgtttcctgatgtgacaaataatttcaaatatattctggagatttcggttattatgtaaggaaactttttatcctatttgaacattccagttcagtccatggtacccttatttggtttaccatataggccccagcctgctttaggggaaatgtagagtcaatgacaatttggttttcaaagccctccccgtgctattctggtcgggtttgttcttctggatctgctgggcctctggttcaatccctgcgcatgttgccggggttgccctgtgcggtgggggtaggttaaggaaacgctgggtgctgggtgtggtctctgagccacggtcagcagagcctgttgtggcctgggtgtgatgctgagggccaggcctgaacggagctgctgtgacatggatcagggggaatctcctcgctgggtctccagtgagatgcccttttcagtcctttcaccagagagaacaggctctttttcttttcttttttccccctgcaggttttggcagttacaggttgcagggttctctgggcccatccaggagatgagagagaaaaagaaaactcagggcctggtacagcgtcacccccaaagtcccaaggttcctggacagcctttcttcctctccatctcctagagtcctcttacgtctgttaaattatttccagggtgtctagttgtatttagagggcagatgccacctcgtcatagaacaccagggtccactctccaggcatttggaaagagttgccacgaggtcctcggaagggtgtgacagttcacacgcccaccagcagcgtttccacgtctccatttcctctgcccctgacagcatctaatgctatgatttttgtttgaaaatttggcttttggttcctttatgaggtgattaattaatacaggctgctggctccttcccatgaatccaaaccttggagatgccatcaaagggatgacagttgatggagcccagaacctaagaggaaacccctgagagcctcgcagaggctgggcaaatgtggtggagtctggggcaggaggggaaccacagtctgagtggaggaggccacacagcacagcccgggccagtctgcagctctctgctccggggcccacctggggctgtcatctgccggccctgctttcctgtagaagatcccacccataccagccccaggaatccaggcaaggccagagcacctcaggagcctcctggagtgatggccatgacacctggtcaagctggctggtagcccctgggcagccctcctccccagcccaaggacagccaattacagcacagggcagccctggacagacagcaccagctagaaggacggggcattccctgcagaccagagcagcccccggggatgagcaaagagggccccagtcatcctgccagaggctctgccccgaggagcccctgcctgcctccctgaaacccaccaggaaggtgtcaactggggcctaggacgaaggcagctgaccgtccccagggaacagagagcggcctgaggaaacgagacagccaggggagtgaactctgggagggaaaaaccgcaaggtttttccttggaggagggagcagatgagcgggtaagaccggcaaatccgtcacataccctcaggacgcagggagcgcggctggaatcagcagttatgcagaaaacgcaggccaggttactggactggaacatgcgggcgcttaagtgatgaacttggtgggaagtttggagagcagaaaatgaacgagtgagacaagtcaggctctgagctcttttagaaggatctgaagggattgaggaggcagaggtgagggaggagaaatattcagtgcttagaagaggaaaaatgaatagataagaggaggtatctgaaaaatgactaggaacttcccccaattaagaaaagacgcacatcctcaaactgaaaaggcctgcagagcgttaattacattttaaagttaaaatgttctgtgtaatttcaaagaaaagcatctacattttgagtcaaaattgctaaaaacttccaaagagaaaaagcaggtaaccctcacaggaacgcgagtggtgctgacattagaattgcagcacagacaacggatgcaaaaagaaagggggtgacagcttcagacgcgagaggaaaggaccctggaacccagggctgcgtcctgctcaccgccatgaaatatgggcacgcaggaagccatcctcagtcctatcagcccccttgagagtcaaccccaaaaacactcttggagaaatatttcagcaagaaaaaggagccagggagaatgctgccaggtctggggaggagtggtgcttcccgagcgtgaatggttcactgccatctaagtaagcaatgacctacgcgtgtgccgcacagtccagcttcctcagaggcggtggtggcctggtggaggaatgtgggctggctgggtggccacagagaattactgtttccattaaaaggaaatgtgttctggccgggagccgtggctcacgctgtaatcccagcaccttgagaggctcaggcaggtggatcacttgaggtcaggagttcgagaccagcctggccaacctggtaaaaccccgtctctactaaaaatacaaaacttagctgggcgtggtggcaggcgcctgtaatcccagcactttggaaggcggaggcgggcggatcacttgaggctaggagttagagaccagcctgaccaacatggggaaaccccgtgtctactaaaaatacaaaaattagcctggcatggtggcacatgcctgtagtcccagctactcgggaggctgaggcaggagaatcgcttgaacctgggaggtggtatgttgcagtgagcggagatcacgccactgcactccagcctgggcaacagagcaaaaacctgcctaaaaaaaaaaaaagtatcacatggagacgtgtgtccgtttgggactgttttccagcctttccacactctctccctccccatctgtccctccatctccaccaagctgtgttttgatgttgtgtttgcatgatttggtgtatctggcattttaacatttgcagggcaaatttctcttcattttgggtttttctctgcctgttcttttgtgtttattctttcagataaacttaattctttttcctttaatgtcctctgataaaaatatgcttcagagaccactgcatgtcactgggttatcagttttaatagctgcaaaaattacatggagtgcttagaccatcatttatttaaggagtctattttggttgttttcacttttcccccatgcccagtggcgatggcttttgtgcagtgtagaggttgaaagaaagggagttccactgcttaaactcaaaatgtgtttctactatagtgggccctccctacctatgggttccaattcatggattcaaccaaccatcagttgaaaatattcagaaaaagaagtggatggttctgtctgtactgaacatgtacagacttttttccttcctgttagtccctaacagtataacacctgtttccatagcatttacagtatacgaggtattacaggtaacttagagatggtttcagctctacaggaggatgtgcgcaggttacatacagatactatgtcatgcacaaggacttgagcttcggtggattttcatatcttcaggggtcctggaaccaatcccctacagaatcctagggatgaatgtatttgccagtcctgtgacttggaccaggcatttaatctttcccagcctccatttgctaatctttataatggtgataagtgttaaacccttcactgtttcagtggggcacatcccagcacacgctggtgaccacttttctggagtagattatttgaagcaggattggaatcatcagtcagggagtaggtacatttcccctccacatttgcaagtcacttcgtgttcctaaacggttgtaccagatcccatgtcctcccacagggcaggaagtgcccatctcctgactccactggtggtgaaggggctcagggcttttcatcttgccagtctggtgagcacaaggcgcttttcattattgtttacatttgcatttttattagacagcaggagggttttagcatctcttcaagtgtttattggccattctcctgtctcctgcaatttgtgccaatcctctgcccatttttctgttgggttggttgcctttcacatattgattttgtaaaagctctttatatattctccatttaaatcccgtggctgcttataaatgttataaaagacttttccctggtatgatgcttaccttttgacgtgtccatgaggcctttctgtattcagaggttttcaatactcgtataatcaaacctggtagttttccttttggttttgaggttgtgtcttgtttgggtgagtctttcctacccctttgactacagaaatgccctttcatttataatatcctcctattatgaaacatatttccacattttctaaatttttaatttttagctgagaaataaattagtaatgattaaagtattaattacttttatcttgttattaattattggttttatttatttacatgtagttggcttacatttagtttagtttaacttaattactttaaagtaatgtataaatatcttcagtttgtaccgcatgttctcactcataagtgggagttgaacaatgagaacacatagacacagggaggggaacatcacacatcagagtctatccgggggctgggtgcaagggaaaggagagcatcaggacaaatacctaatgcatgcagggcttaaaacctagatgacaagttgataggtgcagcacatgtatacctatgtaataaacctacatgttctgcacatgtatcccagaacttaaagtaaatttttaaaaaaattaattaattaaaaatatatatcttcagtttgtaaatgtcccggcaacacgggaacagagttaaaagagtgtgtgtcgtccttagctgctcccaccccctcatctcctccctagccatcccagccaccagtctggcctgcgcctttcaggtttcttcctagacgctggcatacatagatcactattttctgccatgtggtatcttttaaacacacacgattgttttgtgcagaaactttctatttttacctctcataagtgtcctgtgggttctttccatgtcactgtgatgtgtgtgcgtatgtgagattcaagttcagcttgctaatcttgtagaaagaattacgctccacttcccctgtgctctggccctccctaacacagcagcccatccctggaggctgatggagcccctcgagcacttctgcttaccatttctctttgttctgtttgttcaggttttctgcctcctgctaagccaatttatacattccaagaaaatcttccatttcatccaggtgaaacagaacctactggaatgaagctggcctcccgtctccttgatttgaagcagcttctccacattggttattatgccatttttctaaatctaacgttttaaaatttgtgcctttcctttctcttttgcttgacttcccagaggtttttttaaccgtcttttcaaagaagtggttttgggttttatttatcaagtctacttttattatggctgttttaaaattaaatatatttatttcttgtttcccttaaaaaagcttcttgtatgtttacttagtttatataattttatatgtcttttgttgaagcatattaacaaacacttgcagctataacatttcccctgggaactgctttggacatatccaaagattttgataagtcacacacttattgtagtttgtttctgaaaagtttttcattttagtttttattttctcttttattcaaattatcatgcgctttctccttttatcctgtttctgacaaattaatctaaggatataaatctctccctaaatgtcaattttgttgagtttcataattttaatatgtaataccctattgctattgagttccaggcattttataattttcattgtgaaaactaactttgtttccaaaacacactttttcttttttttgagacagagtctcactctgtcgctcaggatggagtgcaatagcacaatctcagctcgctgcaacctctgcctcctaagtttaggtgattttgttgcctcagcctccctagtagctgggtttacaggctcttgccactatgcctggctaattttttgtatttttagtagagacagggtttcgtcatgttgcccaggctggtcttgatctcctgaccttgggtgatccacctgcttcagcctctcaaagtgctgggattacaggcatgagccaccatgcctggccccaaaatgcacttttaacatggtctttgttactgcatgtttctaattttgttgctccctggtgagagaatgtgatttgtataacagcaattctgggaaaggggctgaagcttcctgctcctttagcacagctaattttcccaaacgctgtccatgagcttggaaagagcattgtactctgttgggatgggctcaaatctctctgtaaaaatgagtgttcttctgttgttattgttttggtttttgtttgttttgttttgttttttgtctcacttgttttgtttgctcagatcttttgatgatctggataatcttttaatttatgcaggatgtttctctgcttgtgcaggctggtgggatgggggactggatagaggacaggtgtctgcttgcccaggactggcaaactgtcacttgccctggttgtgccttgccaggagctcccgtgcctgtctctgagagtgtcatgagctcagtggtggtagttgtgtggtggatgcacttccccctgggttggggggtgggtggctggtcctaactgtttgttgttgcagatgagacacgggcgcacttctgcttcctgatggatcttgtcagtcgtttgacttcttcctggtctgggctcctgagttggccctctgcaggccaagcaggaatggagctggctgctacaagagttccttcactagagggcatctctcctctctcctcccacacatgggaacacgcgggtgggctttcctccgcccactgtggtccacagcccggctttccactcctcaccctctgctctcagacagacctgcttttccctggtgtctgtgagaggtgattcttcattgtgccaagaatgtggatttttttgagagcagggactctcacagatatttgcacacccatgttcaaagcagcatgattcacaagagtcaaaaggtagaagcattctgagggtctatgggtgagtggatggacaagcgaaatgtggttatgcatacagtagactgttactgaacctttagcaggaaggagattctttttttttctttctttttgtggagaatggggtctcgctatattgcccaggcaggtctcgaactcctgggttcaagctatcttcccacctctgcctccctaacagctgggataataggcatgagcctataatatcacccggccaggagggaaattctgagaggcatgccaacacgcatgagccttgaggacattgtgctagatggaataagccaaccacaaaaggacagatacattgcgatttcacttacatgaggggcccagaatgggcaaattcagagacagaaagagcaatggtaacaaaaggagggagctggtgttcaatgggttcaatgctcagtggtgttcaatgggtatggtttccttttgggaagatgaaaaggttctggagatggacggtggtaggggatatgcgaaaatgtgagtgcacttaatgccagttaacccacactaaaagatggtacaactgtgcattttatgttaggtatattttcaccacaattaaaaaatttgaaaagagcttggattttggagctgatctgcctgtttcagatcctgccatgaagttctacgagcttgagccagttcctgggcctcctggtgcctcagtcctgcatgtaacacggcgagcgcgtgtgcacacggctctgggagttctcgtgcagcactcagagctcagcgtgggcgagggcgtcacccttcagggggcgtccatggggccttggagaagggaggctccggggcgccacagcagtctaccgggagaggccaggccaagcgcttgttcacccgcagccctcttagggaactttcacatgcttctcccactaggcctaggcacccctccccaccctccctgccctcctggttccctgatcctcagtgaccttgtccttcaagactgaactccagagtccccacccgaggacccgcagtgcccggccgccgcgagctcgcggggtgtatgcccgccccgaggctccaccgcgcctgtgtgccgggaagcctggctccacaggaccctcaggcactgggcgcgccgtcgctgcagctgccaggagctcctgaggaagtggctcgaggccccggggcgggtcaggcgtagggtgggcccgctgccctcacacccgccccggccgcacacaggaggcgcgatcagcagagtcgttggacaggtttggacaccggctgtctctttcgggcctcggttttcgcgtctgaaataaaagcgcgcatcctggccctggcgcggtgcctctgccgcggtagaggtttccaccatgagcccagtgcgccttccaggctcgagggagagggagtgtgcgtgcgtgtgaacgcgtcacactcttgtgtgaacgcgtcatacgcttgtgaaagacggtgcttgtgcacacgcgtgtgcgtgcgtgtgaacgcgtcagggtacccgaggatgcacacacgcacgtgtgagtgtgcgcgagtgcgtgctcagaggacagctctcagcaggctggggacctccttcctctcacccctgagggttttgggggaccagcccccgtatccgggtgctgcgggatcccctgaggcgagcgcgcaccgctgtgctcgggctccggctttgtggggacccggccttcccggcccgcaccacgaggagttccacgcagtagccacgaggtggcaccgcagactcgctaccgcggagcgcggcggctcccggctcccagcagcctcgcctagggctgtggccagggcggtcagtctcaggcccaggccgctgctgccaggaaaagcaggaacaatcgccagtcacgcctgctgatgcccctgaagtgcttatgctcccaggcatgggctgaccgcaacgtgcattctctccttttatgtccctactgtttggaaccctgtttttgtttttgtttttgtttttgttttgtaaatctgccgcttaaaatacccagggtggagctaaaagtacagacactgctcaacttacccctggctgcggcccgataaggccgctgagagtggaaaatgactgagtccacctgactaccgaatagcacagcgtgggggcctaccttggcctgctgagaacactgccctgagcctgcggtgggcagaagcatcaacacgaagcctgttttgtagtcaagtgtcggatacctcatgtaatcattgactactgtactgaaagtgaaaaaccgagttgccgtgtgggactcaaacgagggtttctgctgactgtggatggcttttgcatcactataaagttgaaaactgttaagtggaactgcggttaagtcggggctgtgtgcactagagacctgagttctgccgctccatagctgtgtgactttggacacatatttgagcctgagtgtcttctacacaaaatggatttcttagcataacatacacatgtgtacgcgcccgtgagcatacgcgtgtgtgtttgcatgaacacatctgtgtatgcacgagtgtgtgcacatctgtatgtggctgtgtaagtccgtatgtacatttgtgtgcatgtctgtgtgtgcatatgtttgtacgtgtgtgtgctgtgcatgtgtgtgttaaggccctggggtggagctgagttgttgaggggagatgctgggagggcagccagcaccaggtgtttgttggccaggagagaagctgccatccaggtgcactctggggctcctgcttcagtggcacaaggcttcgggattgaggaagctgggggctggagcagggcagtcctgcacctcatgggaggtgcagagtgaggtcaggaggatggagagagtgccagagaatggggggaatctgaggcatcaggaaaggaagacacaggccacggagagggcagctgggccctgggtgaggccggccctcaggaaggaggtgccacaggtaggggagtgcccagatggagagcccaggggtatggacccacgggtgtatgacagtgggggtactcctgaaaccgcagtattatccaacaagcagggttgggacaactagttatttcatttaaaaaaacaggtcaatgtcagtcctcattctatgctttaaaataagctccagatggactcatgctttacatgtaaagaagaaaaggcaaaaagaaaataaagaaaaggcttgtaagcaggtagttaattgggggcaatcccaggatgcaggagagaggggatggagccacagcaggtctggggaagggagaaaagccggccccgagaccagggcccaaggacccattcaggccagcagtgccttctgtgcacttccgcaaggtcacacgttcttccaaagttgccatcatggagaggtaggcttccacgtagtcttgactccactcgatttcaatccttgggtggcttttcctgtgatcacactcagccctgatacagccattgctggggcctcccctggctggacgttccgcttttggtccacattctttcctcctgccctgaggctggccatgggcctcctgaaggctagctgggaggacctcccttccatggctgtgctcttgctctgcccacgctgtcgcctccatctctacctccctttccatcctcaccaccagcgctcgagtcagtggggagcttttcactcaccaagcccaggcaggtgcgtcacgtgaatttctcttgagcctcccactagaggtagtggcactgttgtcaccctatctgctgaggatatgctggggctggcaggggctacccaagaccaaaggtgtcgctgtctccatcctgtgcccacccagccctgccccctgggatcccttcaaatctttttttttttttttttttttgagatggagtcctgctctgtctcccagcctggagtgcagtggcgtgatctcagctcactgcaatctccgcctcccgggttcaagcgattctcctgcctcagcctcacaagtagctgggactacaggcacccaccaccacacccggctaattttttttttttttttttgtattttagtagagacggggtttcactatgttggccaggctggtcttgaactcctgacctcatgatccccctgccacagcctcccaaagtgctgggattacaggcatgagccaccacacctggcccccttcaaatcttaacagagaagccaccaaagtctccttgggtccatcacatggatggacctcctgggcccttcagcccctgggcttcccttgaggtcctggagctatgtgggctccagctctgggaaggtggacccccacgtgtgtgtcctgccgtcactgtctctaaggagtctggctcacactaagtgagccataaggccttgttcaaggtcatctgtcccactgatttcagacgcatggtggagtctgaaatcatctgtcccccacagtgcattcagagccctgtctggactagggcacacacacatgcatgctcatatatgcatatgcacatacgcacacacatatgcatatgcacatacgcacacacatatgcatatgcacatacgcacacacatatgcatatgcacatacgcacacacatatgcatatgcacatatgcacacacatatgcatatgcacacacatgcaaggctgcaaggctcatgcacacacacacatgcacacacatgcacacacatgcacatgcacacacatgcacatgcatgctcacatgtacaggcactcatgcacctagagccttctcatccttcactttgagtcccccctccccttgcccatccttgcccatccttcaagggctcagtcaaaagccatcttttacaaattgtctctggttgactttcttttttttcccctcttagaagaagcgatgctgtcctcagtcatcgagcattcactgggcgcttcatgtgtgccaggccccgacatgggtcttgggcatgttccagttctcatgtcctcagggctccttggtgagtcgagggtgaggaggacacggaggcacaggaggccacggggcaggtctaggtccactcagcctccagagttcagccctccctgctgagtcggggtgagcaggacagatgcctgctcctggaacttggtgggtgaggtggacaggcatgcagggaggcgccaggctcaggggctgtggaacagagaaaggaagcttccaggacatcaaacaattcctggagtgccagggcaagaggggaatctgggtggaggaaaacgtgaacagggcagaggttggaggtggatgtggcccccgagcacgttggaggcgactgaggtgcttcttgactttgggcatcttcgttcatccctgcatttgcacatttgttgaacacacctactgagacacttgttttctttccatggtccatacattaggaacatagagttagcttcctggggaactttttaagaagtattcttagagaagaaaccaggaggcatcgttgtgggatgttggtccaggatcttgggtgtgtcctttggtcttttgtgggtcaggttagcaggaattgtgtcctgaggtgttgggactgcaaagtacaggttccctcctgcccacactgatgccttcagggaatgacctgtctgctcttctaagaagaacacttaactcagccttggctgacctcagctacctgtgctttcttcagccaggctctgtgttttgtgcttttactctcaaaacaaccctattattatccctgtcccacagacgagatgctgagcccctgagaggctcagtaggtgcctgaaggtcttccagccaggaggtggcagagccagggccggcctggcctgaggactccgaagctcccatgggcacagctccttcatgccagctctgtgttgggattttctgtggttgtcacagccatcttcctggtcagctaagttacagacagggtgaaactaggatggccgagctggaaccagagctcattcctgagcagggcacctgggccctgcctacggtgctgggcaggctcctggtgtggaggtcaggctcagatcctgcagtccctgtggccgtggggcttttctaggcaccctcctgactgctaacaccaggagggcctatgatatgggaccgctgccccatgacgtgtgccaggtttctgcacgtgaccactgggaaaggctggccctgggctgggtggatccgcactgcctgctggcccctgcacccagatggtgcagcccacacccctctgatgcccacccacgcccggctctgggacttccctccttccgctgtgtctgaccctggttgcccttgttctgccactggcttgtagcagcccttccggaagccatgtcctccagggagatttgattatgtcctggtggtgcgacctcgctaatgcaatcaggaagttttctcaagacttcagctgctttgttggcagccaggcctggctctcagcagctctgcaggctggaagggcccaagagacccttcacccacccggtgtctccagcagcagggaggggtccggggcacagcctattgctgctctgctctcctcccttcttggggtaagctcctttgctctgattttatttggaatcatcgagagcctctatctgtctagaaaaagcgcttagcaatgaggaatcagcactgcagagaatactccagaaagcagccattttccatcaagattaggctcttaattgaaaattttaagaggagaggaaattaggggagaatccagatattctctccattatggtaatcagctgtaatcagagcctgagagctgtactcaatcccgggggttctcccaggattaccagagctgccacagtcaccttcaccgacctgcactggagtcagtgggaggggctggcggggtcaggggcactctggcaagtggatccaggagggctgggctggatccagggggctgagttcagagggaactctgcttagcaagtgtgaaacacaggactgggccttccaggcagagggaagattgagaactgcggctgagcgagtgcgtccaggggccccagtttagttgagggtctaagttttcccagcagggcaaggttgagggtgaggatgctgcaggccagttttctatggcctcagagtgaggacaagaagggggagatgggccacagggatgagggtgcctgctccctgcagcagggtgcacatcatggctgtgcagaggcagcaggcggcaggtattaggaagaagcccttcccgtgtgtgtcctaggggctgggcacaggctgggcacaaccctttgctcacggttgcagaagcccatccacatggggtcctgctgaactggcttcgtggggctgggaaggactggcctggcctctttgctcacttcaccttatgggcagtgtcctgcaggtttctgtgagcagagcagacagaaaggagatgcccagtgacgccagctgtcccccgcagagcttcctggagcctgggctctaggctgagggtccttgaacagacgtcatctccctggcttcagcagaatcacccacaaacccaccctgtgcccaccctcccatcacagagagcagctgctggagaacaaggcatgagactttggagacctggaggagcaggagacacaggagacaatggccagggtggtcatggtggcacggctatgccatcactgatttctgcccacccgccccctaagtctcacttgctgctactctcaatttcctacttaatgcttcggagagcaccagtcctgagatgagaggcgggatgttcactctctgggagttgagatggaacccaggcagttagaaaaaagtgccacaaccacgtgccggacctactacttgccaggagcttcgtgagtcatccaattcctaaaacaattgtgctgcgtatgctccaccacgcctgggcgactcggggaaatggggctgcgggaggctcagtgacctgccctgggtgacacggatagcgtggatgccctgtccatgcatggggctgtgctaggaggacaggaccatccccggaagctggtcctgtgtccactgctcacggtggcagctgcttgggctgacaaccgcccctccctcctgctggtgagtccttggatgtattcaggcacatggcagcaaggtctcctgtgtcccagaggcgactaggacccacaagtgagcagcaggtgccccactccttcatgctaaggctcatcacgggacgaaacccaaggtggtattggagccaggggctgtggccatgacagccacccactccagacgatatccacattcggaatagttcagagtggcctgccttgatgacatcacgaacttctccatggaaatgtgtcacagaaccagaacttaagggcatttggatgaggttgaggtgagatcaggtcacagaagaacgttctcaagttaggtgggaaacagctggagactctgggatgtcctcaggacctttatctaagcaaacacatgataaggtctttcccaagaaataagcgtggctttttgtcctggttgaggagggttgttgtggatcttttcccccttttaccttggcttccaggaagctcagtgccaagttttatgctccacccaggcctactatccttggactggtcctcaggtgcagcccttggtctctcctttctttatcgcatgagcccgcttggtttctgtacattttgtccgctggtgctgacggctggacaccctttcctgaaggagatggggcatagagtgagtggatgatgatgggctgtgacagggcccactaccaaggatgtgggctacgaggtgtgggctgggaaggaggaggaggaccctgcacctcagggggcaaccaggagcacattctggggagcacacacctgcggtgttatcacggccactgcccatgtcttggacactggaataaacaggatgtggcgaagccttctgtgtatgggggaagacttccttactcgccactgctgtcacgctctatggccatcttgacccatcactcaggcaacatcagacgcgtctctctgttcaagggctctgcccctaaccttgtgccagaaagaggcttgacagtttgtcctgtctcgaggtttcctctatatctcttgctggggctcccatagactgttctgatttttactgatgaagacagtgccatggtgagcctagcagtgcacacagctcttctctttcccaatcatttccatgggcgaacccctgagtgtagaatgaccactccagtcagattgtgaatacagtgaactgtgggccatgggctcccaggacactgctccggcctggctcctgcacccagactcattgctgttggctttgccatggtaacactagtttggtataaaactgcaccgtctccttctgtctgagtttccttgactgctgtggtggttgagcagttcgccctactttgggttttggtcttggtttcgttgcttttagtatttcacccatgaaagatctattcatacccatcacgcatctatctatccagaatttgaattcgttaaaatgcaagggaatttttaatatataataatgttagcaattggtctgtcatatttgatacaagcatctttctggcctgtttccatcttacttttgtttctttttcatccactcataagttcagactgttttctagtcagtcacggccctggttccactaaggaggggaatgtcccttgagtccccggctggcctccctgggagagtgccacacccccacccgagtccagaggctcaggagctgctctggctgcacgtgttccccgggacaggtcttgggcactggggggtctgtgcctggacactggcattttgcttcattcccactcagggcccctccgcagcaggcttggtagctgggggtggccggacacctggagaagggctgggggcactgcaccagtctcccaggctggaggggccacagtagggagttcccagctcagccccaggggatggccacccctgaatcctcaccgaaggcatccaggctgtcccagatcctgcccacacctgagacctcggctcccgcttctctccgcaggcaggcagagcaggcggcgggatgtgtgggttgaaccctgatggcaatgggaagggtcttcgtgacacagcttcccagcacccaggcagagacaggaggctgggctgctaacccgactggaggctgtgctcacccagtcccctccctgtgcttctggggtctccagaccaccccacagggtacccagatcagtgtgggctcagccccctgcccactgcaccctccttcggggtgccttcctcgtctgtcatgatgttcctgatcctgcacccgtcccctcttcctccagccttccctggctggctgctgtagtcagtctctagggctctgcacagcacttcctggtggtgcatcctggaggacttcccggtagaggtgtctggcaggcacaagcttgctgtgtgcctggcctgcagaaatgcacggtaggcatgcatttgttggatggttgtaacactgactctgggaggtggactgaggttccttatgggtccttctagcatcccctctccccttcagagatgagtgttgaaatttggggttctctgggtgtggcaggaggctggggggtgctccgctcatggccacttcatggcgggcttgggcacagttcggaaggcagccagctgtgtgtcccctgtctccggcctccttgtgtatgagtcaccattgggaagtcgccggcatttgttttaatttaacaggacttggctcatccccggagctctgccactggctcgtccttccttccactgtggagaggaagggggtggggtgcagagtgcttgcaagaaagcactttcccctcatcatctcaaaaaaaatttcttagcagaagcaatgagagaaatttactggcctgtcacaaagagtcactgctcatcagacgagagaaaggaaaagcagaggtcatcaattcatgggcagtgtctcaggaagggattaaatcatttagagacacgtccttaagaaatcattgaaggctcatgctgctgttttctttcctggccttcccatcgcatgcagatggcccctgtccagctgttcagatgctgcaccagcaccattctttttggaaatttgggcagacctcgtgtgtgtatgtgtatgtgcgtgtgtgtgtaatacacgctcatgtgcctacaaattgttatctgtgtgatatggttacataaacacacacaactgttgtctagccatgatggtttcagttttcttgtatttgtgttatgttgcgagctgctaccaattcattcagataaataagggcagaaataaatataacccgccagctacaggatgctggaaagctggttagagtccttggggggtggggtatggggggtgggggtggtctctgtcaccgcagtgccatgcagcgcctggcacggtggcgtcctcgctcctgtcatgagacagtgggaagccataaggcgcctggggctggcgcatcccttgggtcactgcacagtggtggggagctttagctgggatgccagctgggcctgggttcaggtcccagctccccactagtgacctgtgtggccagctgtcctcaaccttcagggctgtgtgagcctgaaacatgtggtgctgcatctggcatttagattgatgtgtgagggtccttttggtcattcgtgtgcctgctgctcaggtgcctgactcagcaggacagcccataggtcccagcatgacagcaggcatggggcatgaggtgggcataactaagatgttatgctggttaatttatgtgtcaacctgatggggccctggggtgcccaggtcagatatgattccgggtgtctgtgaggacatttctggatgagattagtgtcggaatcagctgcctgagtaatgcagacccttcccatgcggttggggagcatccactctgctcacggcctggagagaacagaaaggccaaggaaggaggacacctgccctttgagctggggcatgggtcctctcctgtccctggactggggttcacaccatgggctcccctggttctcaggccctcggactcagactgaagccaaacaatggctccccaggctccagcatgcagacagcgggtcctgggacttcttggcctccacagttctgtgagacagttcccatgacaaatctgtgccatggacctgggtgtctcctacaggttctgttcctctggaagaccccaacacacacatgaaggtggtggacacagcccagccagttgtgaaaaacaaacaagacagacagataagaggtctctgttggaattaaatagaagactttccaagcactaatctcctccttttgctcatcctagaaactgtggctgagcacccccctgcaccagccctgtgtccaaggatcactgatggatcccctgccctgcccagctcagtccaggggcggtgcttgcgttcttgggggatgaatagagatgctcagaggccaactgcagggccatgcctgggggctggatggtgctcccctgtctagggcactcagctgcatagggtgctcctctgcatagggtgctcccctgcatacagtgctcgcctgcatggggtgctcagctgcataggatgcttggctgcatacggctctcaactgcatagggtgctcccctgcatagggtgccccccagcatgggcacctgggtgggtccagagccatgtggctgccaccctctccctgtggaagggacccagtgaggagagctcagcaagaccacataacagaagggggttggagaggtgccagcctctgccaggaagcctcagtgcacagagcagccatggctgggctgatagactcatcttcagtcttattgccttcttacgggagacacagaggcagagatcatgcagggcagggtgaggagggcccaagcttttctcagggcctagggcccggagcatggccctcctgcccacccaccccggagtgccttcctgtctcttcacatgatattagcttccctcaccatcttctggtcccccagcagtgtcacctgaggcctgcctggagctatgtcaggagtatcaaccgcactgagagcttggtgagcaattcatagccttgcccagtgggagtctgagcatcccctgtggccacctgagtggatgtcaagtggggctgccctgcccccagcccatgcttgaccccgggatcctgagcagattcctggggcaggttctgccttccttccctggggctgtgtctctgtcactgctcaggagtgacagtgcctggacatgctccttgggcttctggggtgttggtgggtggtccaatggcagggacagaggagcagtgtccttgggatggccagaggcatcctcctatggataaagtcggtggccgatggctggagggctgactgcgggcctgctggggccctgctcactcactgcagtggaacaggagcccccgatgcagccccatcctcagcccagccaggggtgggagggagaggacagggcccttcgatgcacacccttttcccgtcccggagagaggggaggccgctgcatcatggcgcaccctcctggggcttgggtgaatgagtgcttactgctctttggagaggcaggtgacccatctgctttctgcattggttacgcagccccacacaatgcctggggactcagggcaggtcctgaaggtattgggcttctcttctgtccttctcactcccccagagagactgggggttgagtgtagccatagccagcccccctttcatgataatcagatgggctctgagtggagaccactggggctgcaggcacttatgagatgaggatgcagagataaagcccatggtcccttctctgcaggggccagagcccacagttgtgcagagaagggataaagccaggggagcacacgagcccccggcccacctgggagggcccagcaggctccccgagtgagccctggggtaggatgggcagcctggaggggaagaggctgaaggggccacagaccagcctgggcatagagcaggctgcaggtgaccagctcgtccctctgcccggaacctacctgggaaagtgcccatcccagcccaaatgggacggctactcccctggtgggaggcagggtgtgggactaaggggagatgctcagatggcgacaagccacctggagcttagacttggacctatggggtgtggaccaaggaaaggttgggggctccaggcctgggctatgcctggaaggacgatgggcaggggagatggggtccatcaggggcttctttgatgcaggcacagagtcggagccgggcttccggggagtacacaccctgaaaggtgtggagggggcaggatcagggactcggcgctggatggtgttggggtgaggcaaggcttggcccaggtcccggctctgcatctgggtaggtggctgtaggtgggcaactgctcctcatgggaagctgaccatctctgtgccgggctggcggacaggaggtgtccagaacagggcagggctgaagtgcagggggcccaggctggagactccccgattggagggcccccagtgaggggtcatcgaaagcaaagagtgcccctcagtgctcagggctaaaagggccaggtccaggactgctggaggagggcccaagaagtgggtcagggctcagacgccaagaagggaggggggcacagggcagggcaccatcagggccaggaagggacaaggggggccagggtccttcagatttgccagtcagcgttccatgaggagacaagcgtgagccagcaagacggtgggcatggccggtggttctccaaggcttcctcagggcacgcggtgggctgtgtggggtgtcacgtgagaaacggcactgagattagtaggcgtgacaaagctgaattcctcacaaccgctcccctcagggcccaccacgggctcctgcaagggcggggaatgcaggtgctgggccccgcgggaggagcagccacagcgggggacagggaggccagagccgagtggagaggagtgcgggactgaggaggcttttatcccccgaccttttctgaagagagaagagatagaagcagagtcatgagtgctagagacgggcagggaaggaaatggattaaaggagctggaggagagggtcccggagtgtacggaggagtgagaccctggccccaccgcctccctgggtgtgcgagtgggagtgtccaggcatgcatgtgcgtgtgggtgtgcgagggtgagtgtgcgagtctgggtacacgcgtgtgtggtagggagtacaggtgggggctggcgcagtgagaggtgggggctggacgaggcaagggtgagggccccttggtcagggccgcccactgcccgcagaagcccagggcagtgaaggcgcccaggagcaggtggttgggttgactcaggttggagaccccgctgggggtcagcagaagaatgaggggtggtgaggggcgctccaggcagggtggtgaggtagagagaagagaggcctttgcattttgcgtattctgttggtggaggaaatggtgagccatcaagggctgctggcagcctccccctaaaccagcccaggaaatgctggaagagagagactcagagcaaatatagacccacagggatgcctggagcacagacagggtcaggttcaggttgctggggaggccatggcacaggtggaggacagctggaagcctccacgtggtgctggccccctcctgctccctgggctgagccagcccaaggggcacgcaacctctgagctggcagtggccgctctgcccctggctacagcaggtatcagagcaggcagttcagacccaacacaaaacccaaacatgcctgcaggagcagctcccagttgcgcccagctcctaaagaacacacctgtgccatagaagacagacagagcaggacttagaacaagtgaccaaagtcctcagaggacttcgtcgtaagggagcatgcaatgaacatgagctcaaaagaagcggctgtcatgacaaaccagttggggatgttgggtgtaaaaaacataatttatagatagaatagaattcattaatataatgtatgaaactgtaatataattctaaataaatataattgttgaaaggggctagaagattttaccaagggactccccagaaagcatcaggagggtataaggaggtgggaggcaggttgagaggtgaggaaggtggaacaagacggcccctgcccgtctccaaggagtcctgggaagaaaggaagaataccgggtaggagaatatatttgaagaagggttggcagagaatttccaagaactaaatacagacacaagactttagatggaagtgttcacagagtggcaagcacacacaccagaaaaattagaatcacagagggaaaaacagttacagagatacaagagtgagtctgacctcagagttctcaaggcccgacagaaggcaggagaccaagtcaccaggtcagtggggagcatggacaggaggtgtgaagtgggcatagctaaataacgagaaggatcgaattggaatttcagcccaatataccattagtgtacaccactaacacccacataaatgatgctttgtatttttcttatctacaaatacatggaaatacagctgacccttaaacaatgtgggggctaggggcactgaaccccctcacagttgaaaatttgcatataacttttgacctcctcaaaacgtaactattaatagtctactgttcactgaaaccttactaataacacatacagtcaatgaacacatgttttgtaggttatatgtattatattctgtattcttttttattttattttttgttgtttacccacactacacagatgtatcacatgctatattcttcaatgaagtaggctagagaaaagaaagtggtattgagaaaataataagccagagaaatttatttactcattaagtggaagtggagcattgtaaaggtcttcatcctcatcttaagcaggctgaggaggaggaggaggaagggaaggggttggtcttgctttctcaggggtgtcagaggcagaagaaaatctgtgtgtaactggatgtgtgtggttcaaacccatgttgttcaagggtcagctgtaagtaagtaagtggcatgtggcctggagaggtaccacatatatggggaggctgctgatgttaagtgtgtgaggaaggagatagggacacgggagaaggggttagaccaacacaacagtatcaggggctgaagtggggccctcacagacagatgaaaaggagggggaagggaggcaccctgccaactggggaccacatagctttgtgcatctgaaagccactgaaaacagggaaattttatcacctctagacctgtagggagggaaaggaaataaggaaacacagtccactggggaccaagaaaaaagtggtggaaagaaaataagatggtaaaagtcattcaaaatatccttaagacagtaaaatgtaatgatgttacaggaccaccaggttcctacacctgctgcgcagttacagaccaatgcaccaagacagcaggctttgcagcagagaaagagtttcctgatctcagggcagctgagtgaggaggcaggagggaccctcacttcatctctctgaggagttttgggctggagtttttaaaggatcgtggaggtcaaggggtggaaaattggggccactgattggtggggctaaagaggatgcaatcatcggggtgtggacactgtatgttctggtgagtcagctgcttgtggggtccctcagaccagatggaatcagctgtttgattggtatgcaggacctagaaggatatctcaagtggacaacttaacacttcacaatgttcaagttgctatctatagaggatagttgttatctatctgaacttaggggaactggggccttgtaacggattacaaggtgattctgaggcagtatgcatggaatggtagtgaggaagggtcagagagcaagctggcctagaagccaacactcaggacactgcaagcttggtttattttcctttctctccctcccttctttcctaattaattttataaaacgtatagggatggattcaataagattaaactcatctattcgaaacatggattctcaggctgtgtttttttacatttttgttttgttttgttttgtttttaaagcaagctatctgctatgaagtgttaacagaaaggaagtgggtgtgggaagcgaccagtaaggcagggagaggtgcatggggtggggtggagggcagtaccaggtaacttggaaggaggtcatgcacctggaagatgcagccaccagcctcagtgagacaacagcaaacctagcatgtccccaggcatggtgggaactttgaacatacctcactctaaaatttgcatcaaacagaataaaaatcatgaaaataaatagatctgaaatacagattttaagtttgggctgctgggcagatacagaatcctgtaccccatgcgccgggcattaacattttttccagcacagatggaacatttataatactgaccatgaaggtggccacaaaggaggcttcaacaaatagcagagatgataagcaggacatgctctctaatcacaatgcaataatgttagaagtcaatcacaggaagactgccttgagcccagttacatctggaaaacacaataactcacgggcccgaggaaaaacggtaatggaaaatacaaaagatataaaccaagcaatgatagaagcagcatatattgactctcatgggatgcaggtaaaatggcactagagggaaatttataaccttaagtgctgtgttagagaacaagatagaaggcaaattaatgagctctgcgttcaacagcagatgttaggaaaagaggcacagaacaggctcagggaagaggccgaaggcagagccgggctggagaaggagagctcagggaggctaagagcagtggcctggggaaggggcctggggccgtgggtcaaggatggagtcctgttgggagtgtggggagtgggtcagggatgctggattcagcatttgaggatgggctgtgctgtgtggatgaaccatcaagatagacatcaggccccccagaatttggcaagactggaggtagagccaagtgaatccacgccagagtcctggattactatgggccatggcagtggtgtggagagaccactcagacctaatgagcctgcaagactgtgggttccgtctgcttacaggggagagctgggatttaagggaacaaaagccttggggaaagggagcgggctgctcaggggaagtggatatcagtgaaagccaggttttgtttaaggtgagatgtccgtgcaagttgagtggaggggtcatggggcacctgtttctctgagtccccagggggcagggagagggatgggttagggctgggtggggaccagggtggctggtggtggtggttatacccaagcacagcagggttgagactgacaagctcatccagcttctgaatcctgatggaggccccagagcctggtgccctggggactctgcggagggtggtgcaggagcacggccctcaggtgctgggagtgaggtgagcagggtcaccccacacctggcctgcccctcctcccttgaaaccagcggtgtgtctgagcactgggcctgaaagcatggcatctggaggcccaaggctaatgcccatggcctcctctgcctgctctgcttgtccaggggctgagctgtcctggtctctccctctgctccttcatgcagaggtcttcagagcaccctaatgtgtccaatcaaggccaggcttgttggtgagacactctcggtccccagctccatgctagatgtctccaccctcaaaggacccagcatctcatgacttcatgtcccactagcagtccctgtgcccagttcacccatccccactgaccaccaatgtttgatttttccttcagaagcatgtgaggaaatggattgttgattagcctgattcaatcattctacattgtaaacatatcaaagcatcaccttgtatcccataaatgtatacaattattatttgtcaataaaaaataaaattaaaaaagattcagttcccagctgcctcctccaggaagcgtgcagcactctcccttgctgaggaccaactttacaccagttcttaccctggaccctgcagagggcagagggcacttgggctgcccatcagggacacatccatgcctctctagctttctaggaagcttcctgtctcagcccaggactttgggaaggtggaggtagtcacctcctacagtcaggacagctgcagttcagagggaagaggcacaaagtcctcaggttgaagttacccagctggaatttcctttctcccactgaaagaggatggtgatatttgggactcagggttgatgtcaccatgggaggtctactgggacagatgctgggatgttgagctcatgcctgcagctgtacacagtgggcagtgtggctgtggctctgggcacctctttccttggtgccagatgtgctgcctggccctgtatgtaggaggctggacctgctgggccttgtggcagggcctcagggtccttctggtcacctcttcctccctgcaggtgcctctgcttttgagaaactcaaagccaaggacaggtcactggatgtgctgggggcaccaggactggtggggtagggggtccttggtgccaagttcaccccaacctcagcagggagaaggggctttggaaaggccctggcccagggagggggcggccaagcaggcctggctggggaggcccaggcattgcagttgggccaggggcccgtgtgagggaggcagcctccccttctctaggatggggccagtgcccagctctgcgagacccgtgtcctgcaccccacaccccagtggagcacagcatgaggccctcaggcccgatcccgtggttgctggttctgcgaggagattttgaatccccactagattgtcttaaggttcataggcatttttgggttttctatgtctttttcagacacgttccaagtttggtctcttcaggttactgtctgttttgtcagttattggcagaataatgttgtatagtaatttgtaaaatgtctgttatatttaaagttatgtctccatttgatttattgtgttatatgctgtgccatccctcttttcattttcttggtcaattattctagaggttggtttacttttattagtattttcaaagaatcaccattttaattttgttgaccctttctttttttaatttttaattttcgtgggtacattttagtaggtgtatatatttatggggtatgtgagatattttgatacaggcatgcagtacacaataatcacatcggctgggtgtggtggttcacgcttgtaatcccagcactttgggaggtcgaggcaggtggatcacaaagtcaggagtttgagaccagcttggtcaacatggtgaaacaccgtctctactaaaaatacaaaaaattagctgggcatggtggtgggcacctgtaatcccagctacttgggaggctgaggcaggagaatcacttgaacccaggaggcagaggttgcagtgagccgagattgtgccactgcactccaacctgggcaacagtgcgagactccatctaaaaaataaaaataaaatcacatcagggtgaatgggttattcatcccctcaagcatttatcctttgtgttataaacaatccaattatactcttagttatttttaaatatacaattgaattactattgactacagtcaccctgttgtactaaatagtaggtcttattcattctttctaactactttgtttgtacctatttatcttcatcatttctcttactcccctactacccttcccagactctggtgaccatccttctactctcttcctcaataagttcaagtgttttaattttcagcttccacaaataagtgagaacatgtgaagtttgtctttctgtgcctggcttacttcacttaacataatgacctccagttccatccatgttgttgcaaatgacaggatctcattcttttttatggctgaacagtactccattgtgtacatgtactacatttgctttatccattcatctgttgacggacacttaggttgcttccaaatcttggctattgtgaacagtgctgaaaacacaggaatgcggctatctcttttgatatactaattttctttcttttgggtatatacctagcagtgggattcctggattgtatggtaactctatttttagttttttgaggaacctccaaactgttctctatagtgattgtactaatttatattcccatcaaaagtagacaagggttctgttttcttcacattcttgccagcatttgttattgcctgtcttttggataaaagccattttaactggggtgagatgatatctcgttgtagctttgatttgaatttctctgagatcaatgatgttgactccttttcatatgctgttttgccatttgtatgtcttcttttgagaaatgcctattcaaatctatgctgagacacctggagctggaggtgggatgacacaagcacccctgtggctgccaccactaggattgtgctgggccaaacctgaaaccagcacagcactgggtctcacccagggcccattgtaaccactacctggctattacctatgtttgcttaaggccctagagctctgcaatcagtaggggtgaagccagccaggcttgtgtccttcccttcaggatggcaagttcccccaagccctggacaggtctagatacactgtctgggagccagtgactggagtcaagaaccttagaaatctgcttgatgctttattctactgcaggtaagccagcactcaaatcacaagacaaagtcctcacttttctctctgctttccacagaaagaggagcctctcccatggtcatggccaccacaggcctacatgggatactgccaggctaccaccaatgttcactttaagcccaagcgcccttcagtcagcttatggtcaatgctgccaggcctggtagtcacccttcagggcagtgggctcccctctggcccaaggcaggtccagaaatgtcatccaagagccaaggcctttggaatcagggatcccaggagcctgcttggtgctctgctccactgaactgagctggtacataaggtgcaagactaagtcccctttactttcccctctgcttttctcaagcagaagcagtctcttaccataaccaccatagctgggaatgtgctggttctcccctgaagccagcatgtctcagagtctcacccaaggcacatggcatactacctggatatcactactggttcttcaggacccaagggctctttagtcagcaggtgatgaatcctgccaggactcggtccttcccttcaaggcagtgggttcctttctggcccaaggtgtgtctagaaatgtcatccaagagctagggctcaaaatgagggccttatgaccctgaacagtgccctattctgtggctgagctggtatccaagacacaagacaaagttctctttagttccctctcccctccttaagtggaggaaagaagtcgctttcgttgctgtgagctgtgctgcctagggctgagggaaaaatagcacaagcatgccctcagccagcccagctggtgcctcactaggtcacatgcctcccacatccactggctctgagcccagcacggcactaggacttgcctgggaattgcagtccttgtggcctagattgactttcaagtctatttaggaccccagagcctttgagcccacagtggtggggcttgcaaaaacttatgttccaaccattgggatggatgatgatgcccctctgtctagggctggtctaaatgcttcctctgtgggtgggtgtcaagcaagtttagcctggtttttctttctgctctgacagagcagcacagagttcaatgcagggtcccataatcactgcactctccttcctccagtgcacagattttccatgccacaggaccactactggggagtggaggaggggtggcttcagggattcaagactgtgttttctaccttcctcggtgcctctttcagcgataggaagttaaaaccaggtactgtggttgctcacctgattgttggctcttatgaaggcttttttttgtgtatgtagatagtagttaaatttggtgttcctgcagtgggggcgataggtgaaatttctattcagccatcttgctctgctctcccttgaccctttctgttttatctttatttttccatttcattaatttttgctcaaatcttgtgcatttctatctgcaagcttatttctaaacttttattaatgtcttcatctgggctccgaatagcctttcttaataggtaaagattataaattcctgtagggtgttctagtggcagccctcaatttttgatatgtattattttatcagtgttgagttacaagcagttgcatagtatgaagtcttatgtgtctcactttttgcactcaatattttgtttgtgagatgttacatgtagccataatttatttattctcagatattatacataatctttcataaatgaatatgtcaccatttttccatctctctgtttgtggatatctggcttgtttccaatctttggatattatgaataatgctgctgtgaccatccttgtacacaactcttgaggtacatgtccatacattcatgttgattatgtatctaggaatgaaatctctggggcataggatatgcttatgttaaattctattccatgatgccaactgttttccaaattatttgtacaacatgcactttctccagcagtgtgtgagtacctacttctcctccagtcttgccaatgcttactattgtcagtttttaaagttttagccatttggcagatgtataatggcggctcaaagaggtgtgaatttacattttcctgactactaatgtggttaaacaattttgtatgtgtgtatgaattccctgctgctatggtttgaatgtcccctctaaaactcatgtggaaacttaatccccaatgtggcagtattgagaggtgggggcctttaagaggtgattgcatcatgagggctctgctcctaattcattcatggattaatgggttagtgaattaatacattatcatgagaggcaaacaggtggctttataagaagaggaagagagatctgagctagcacactagcatgctcagcccccttgccatgtgacaccttgagccaccttgggactctgcacagagtccccaccagcaggaaagctctcatcagatgtgaccccttgactttggacttctcagactccataactgtaataattaaattccttttctttatacattgcccttctttgggtaagtcctagttcaggtcctccatattcttaattattttctgtctactagttctaacagttgctgagagggagatgttgaagtctccaactataattatgaatttgtctctcctttcagctctgtcaatgtttgtttcatgtattttgaggcactgcttttggtgcatatgcctttagaattgttatgacttcctggtggatttaattatgggtatgttagagcttaagactaccattttgttatttgttttctgtttgtttcctctggttatcattcctttttctcttttattgttacttgaatacttcttagtatttcattttgacttatttatagtgtttttgagtgtatttcttcatagagtttttattttggttatttcaatagacatatgtgacttatcgcagtctgctggtatcaatgttttgccaccttgaaggacatgtggaaacctttcttccatttaggtcccttatctttctttctttcttccttttttttttttttttttttgagacagagtctcactctgtcgcccaggctgcagtgcaatgaagcgaacttccgcatcctaggttcaaacaattctcctgcctcagcctcccgagtagctggaattacaggcattcgctactacccccagctaactttttgtatttttagtagagatggtatttcactatgttggccaggctggtcttgaactcctgacctcaggtgatccacctgcctcgccctcccagagtgctgggattacaggcatgagccaccgtgcctggcccctttcacaatgttatcttgagcatcaaataatgctataatttttgttttgatcttcagattcttaaaataaaactcacatgagaaacaatggtctatggtttgtactcatatgcttcgtttttatgttgttctttcttatgctccatggctccttcttttattatttccttcctgctgaaggtcttcctttagtcaatttttaaggataggtctgaaattaacaaattcttctagctttccttcatctgagaatgtctttagtgccccttcattttggtaaaatagtcttgccagatagagattgtggttgacagttcttttctttcagcacctgaaaaatgttgtaccagttccttctggccttaaatataaaaaagatttattatgacaatatatcttttataagaggttatatcacccatggtttcaaataagaaatccactgtcaaaccaaacaccgcatattctcactcacaggtgggaattgaacaatgagaacacatggacacaggaaggggaacatcacactctggggactgttgtggggtggggggaggagggagggatagcattgggagatatacctaattctagatgatgagttagtgggtgcagcacaccagcatggcacatgtatacatatgtaactaacctgcacattgtgcacatgtaccctaaaacttaaagtataataataataataataaaaagaaagagtaaaaaaaaagaaaaagaaaaaaaagaaatccactgtcattcaaatggcacttgtaggtaaaatgacatttttttttctggttgttttcaatattattgtctttagttttaataagctcaattatgatgtgtcttcattattacatatgtatagatgacctgttggccctgtttctctggagaaccctgactcttacatggtctatgagcctagaatattttgttgtgccagaaagtataggagtcctagaaaactgattagggcaaaacaaaggacccaggatccagcttgatgaggctcccactggccagatctgagataatctgagcataaaaatgaataatgacaggattgtaacccggtgactaagaacaggatacatgctatcattttaagttataaaatgaatgaatgaacattcttttttacaaggaatggtgtggaattagaaaaccaccattttgtagccaccattggaataattgattcaggcagaaaacatcaatggatgttcaaatcattagatggaagttaaatgagaaatagatttatttatatgaattactttttaattttaaaggggaaaaaaagataccattacaatgggaaaatctggcagatactaccatgatattgaatgaaggttagtaacatgagtaacaagacaaaccagcatcatgttgatgtcctgagaagaatacagcaccattcctgccagaaatgcatggcccaaatctaatcacaaaggaacatcaaactcaagtaaaacacattgtacggaacagtggcctgcactcttcaacgatgtcaaaaatcaatgttaaattagataattatattatggttatataagagaatgtccttgttttgagacacaggctgaaatgtttggaaatggttgtgatatctgcaaggtattcttaaatgttacaaagagagagagagcgcgcgcacaatagagcataggcaggacaaaaatgttacctgatgactccaggcaaagtgtttttggaggtggactgtgttactcctaaaaccaagtgtgttctgccagctcagggattctgggctgcttggatttttgaaacaaacacacactcatcagagggctgtaaacagtgcaggtgatgcctgaacacagctgactgctatcttggtttaaaaatgcagactctggagctggatggttgaatctctattacacccccaatttgtgtgatcttggtcaagttcattgacttctttaggcttcagttccctcatctgtaaaacagtatgagaatagtcgctgtgttctaagattgctttgaagattaacatgagtcggtaatatctataatgcttataagggtgcctggcacacagtaacgatgaataaatgctaattattgtatttactattagtagtaattggacaggcagcaaagaagatccttcaactttctgtctcttaatggtctgaaacttccatctgttactatttaaaagaatttgggtaagtcctcgtacagaaaatgagtctttcttaatttcggaatgatggtaaaacattgggttttagtcccaccagtattttctacctggaaaggaactgagccagctgggtgggcagtacagaaatggaaggagggagtagggaactgatcctgcttgcaaagacaaaagaacaaggagaccctggggaatgcagaacctggcaccatttttcttcaactaccatgaaaatagacagactgcctgatacggtttggctgtatccccacccaaatctcaacttggattgtgtctcccagaattcccacttgttgtaggggggaccgaggggaaggtaattgaatcatgggggctggtctttcccatgatagtgaataagtctcatgagatctgatgggtttatcaggggtttccacttttgcttcttcctcattttctcttgccaccaccacgtaagaagtacctttcacctcccaccatgattctgaggactccccagccatgtggaagtgcaagtccaattaaacctctttttcttcccagtcccaggtatgtctttatcagcagtgtgaaaacagaccaatacactgcctgacactctttgatgaatagtttttgcgtcaaagagtaaattgggagtaaaataacagaagataaaaacaaaatattttggaaccaaaagaagaatgcctaagctatgctcagtagtacattcatagttttaaatggccttaaaatttaaaagagagagtttcatgaaccattatgcttatatcttggttcttccaaagtgctgctaaagtcttagcctgctgcaatgagtacctgggcaggtatgtgaaatactccaccttggtagagataacagaaacataaccttgaccttcccattaaaactaaagggaaaattcgactgaagttttcaagtagtacccttaaggaatcacacatagaaggtactcaataaatattatagcttgaataaataaaacaatgccactgagagcctcaagggtctggagtactctcagataactggcgtattagttagatgttgctctgtaacaaaccacttcaaaacttagaagttacccagctggaaatttcctttctcccactgaagatgggagcctattttaggggcctaaaatagtaaccttttattatttctcatgagtccacaggacgatggggcacttctgctactctgggctggatgtggctgatcttaactggctcatcagtgatcagccagtggattggctgggcctggctcatctcagatgacttcagccctccttcccatgtcctgcacatcccttcagcaggctaagctgggcttgttcttatggcagtgccagaggtccaagaaatgagtgaaaatgcacatgtgcttttccaagcctctgatcccatcctgctggccaaagcatgtcacagcatcaagcccaacatcattttgggagggccctacttaaacgaatggcgagagtgatatatgaaaaattgggccaatttctgcatgaatcctctatgattgggaatcacgtagataagtgttttgggacagttcatccaaatgacagacataaaataatgaaatgtgaaatgacagacataaaataatgaaatgcgtggccatctccttaccacagttgattctaacccagttgttgaattatttgccatacctcactcagttcagcatggctatcagtatgatgcacccttctatgtctctgaggatttataagagatctaaattttttaaaaagaaagaaactggactgccatccaacagttcacaaaaatcaatttcagatatatcaaagacccagaggtaaaaagcaaaatttcaaagctttcaaaattaaatgggggtgggggaatctcttaatatccttagagtagaaaaaattctttaaaaagacacaaaatgcactatctatataggacgcattttcaaatctagccatattgaaattgatgatttttgttaatcaaaagttacctcaaagggaatgtttttaaaagtcatgatatgagataaaatatttgtagcacatgtaaccaacaagtgactagaacctgggtacataaagaactcctgtaaacagtgttgtgctggaagatgtttaacaactgactctcaggccctaaaagtccttatttttagcatttgcttgtttccaggatataaacacttccatgtggccaatttcaagccactaaggtaaggtcaccaagcagggccttggggatagatggtcgcagttggctctcacaaggcaggtataaaggctgcagcacaaaagtcaacatgaaaaacaaaacaacccaatgggggccaggcacagtggctcaagcctataatcccagcactttgggaggccgaggcgggtggatcacctgaggtccggagcttgagactagcctgaccaacatggagaaacctcatctctactaaaaatacaaaattagccagcgtgatggtgcatgcctgtagtcccagctacttgggaggctgaggaaggagaatcgcttgagcctgggaggcagaggttgtggtgagccgagatcacgccattgcactccagcctgggtgacaagagcaaaactctgagggaaaaaaaaaccaataggaaaagtgcaaaagacttcagaaggcttttatgagggctgtcttagttcatttgtgttgctgtgaagagatacttgagtgtgggtggtttataaggaaaagagttgtatttggctcaacgttctgtaggctgtgcaagaagcatggagctggcattaggcaagggcctcacgctgcttccactcatggcagaagggcaagggagcccatgtgtggagatcactcggcaagagagaaaggcaaggaggtgccaggctctctctaacaagcaggaacgaatagagtgagaactcacactccttccccatggagggcattaaagtattcatgagggatccgcccccatgacccaaacacctcccattaggccccacctccaacactgggaatcaaatttcaacatgagatttggaggagaaaaacagacaatatcaaactatagcaggggcataaaagaaaacctaaatggacaataaaaacctgaaaagatgctcaatcttgtaactgatgagggaaatgcaaattaaagccacaatcagatacatttcacaccctccagattgacagaagttaaaaagtttgtcagtttggggttggtgattcggagctgtggaagctctcacccacggctggcggagcctgtgctagtacaaaccactgtgagaagcagtttggcatttcctagaagaggtgactgtgcacaccctacaaccagcactttcattcctgtaaatgtaaacgtgccctagggaaactcttgcccatgcaccccgcaggacacacagggttcgcgggaggaccattagcaatgggaaaaaatgaaaacaacccatgtgcccatcagcaacaaaataaactataatctctgtatatgatggaatacaatttcacagcagtaaaactaatgaattgtggctacaggtatcaatatggacaaatcccaagaacttcatggagagagagagaatcacaaaagaataaacgtcacataactgcaatactataaagttccttatctatactaacaaagacaggggtgtttatcagcaaactcaatttggtggttggagagaggggcaggagagcaagaggggtatgatctgagcgtggggcaggaagaggggctaatccatgcgactggaaatagttcgttctcaaactgggtgtgagtgtggaggtgctcactgcattgttgctgctgagacatacgcttgcattggatagattcttccacgtgtgtatttcaaatttggcttcatcacaaggcttgtgggggagtgacaaagcagtgtattaagtgtgacagctgaggaaagccccagcagcaggggacagagagaggggcacatgttgtcacctggaggtggggtggttgcgggagaaacgtccaggctacaaaccgagttgcgaatcacagagggacttaggccgggaaggggcagcacggcgccctccaggcagagaagcagccccgcggccaccctgatgcggcgcggactcctcctgtccagttctctgtcacacctgctgcctgccccctcgccaacccctgcatacatggcccgcatatcagaggcggacgaagaagcggccagaacttagccagtcttccttcttcatcttccttcctcctagtaaaacacacacacacacacacacacacacacacacacacacacaaatgggcattagcctttcctctggtcgtgcctctatttcagcttgagattttcacctttcatcgcaagggtcttcgcggcagaacgtggccgtccccacagccgtcgggggtttcgggttggatcccgcgttcgctccgctgcttggcctgcgcttcagcctctagcgacccagcgggggcgcgacttccgagccgcctccgcctcccgcctctaccgcggggccggggcgaccccaggtctgcacggccgaccgctgcgtccagagagatggggccgagcctccctgcggagcagaaccgtgggacggagggcggtgggctccgcagggagggggcgcagtccgggacagaccccagcacaggctccttccaccctcccgggacagctccgaaatcccagccctacgccggagctgcggtttgcaaagcgcggctgggccttaggtcttgcccccagtttcctatgccctaggacgtccccttgggggccagccacccccagcccgcggagggaagaggggcccttccttcgcggaccgagggcggcagcctgtgtggggatacctgcgcaggtgcagccccggtgagagctccttaccaagaaagagggacattcatttccctctccaaggtagcagcgttgaaaggcttctccacagcattactcagtccaactaatgatgggaaaaggagggaaaaacgagggcgccgagccgcaaccgcttgcctacctccacctaaaacgcaaacacagcccgagtcgccagtgaccctgactcaggcggccgcgggcgttccccacggcaggacctggagccacacccgggccctcggggctccatggcagcgcggcagcgcctccttcgcggagaagccccactgccaggagaaccactgccgtcgggagacgacgtctgtatttgtagggagtgaaaggaggcgccgagtcccccacgtttcatcgcagggtcttcggggcagaattcggagacacctgtcacgatgggagcagtcagggctttcctggttttggggcctctggcttaggtgggctggcaatgcctctcctttcattcctgataaacatgctgggccggagcacagcggccatggggctgtttcttgtgagccacggctagttctaaactgtactgatttggacacctgccaccagatgagaaattagtaaaatgtggttaccaagggactgcttctctgctctagctgtgaacggggtccttagcggcctgcatgcccgcgcctctccagactgagaccaaagacttccgcgccaccgtcggcagctcgcgaacttagacttcagaccgtctgccgcactgcaataaagagaccatggtggggataccttttaaatgatttaaatgtgtccttccttctgcagcacacacacgtcctcctgaactggacacctggccaggccaacgaaaaaggagaagctcttttgtaaggtggcagggacgcacccccttagctagagacaggcttctaggtggctcgccttctactggtagaacatgtagggttatctgctaaagtgtgggacctgctacattgaagccaatcttctctgagcaggactcaatttatttttttcttaattgcaacacatgaaaattttaggtcaccaagaaacactagtcaaagggtttcattttctgtttatggcctatttattacaattcagaagaaaaatgaccaactagaaaaaaaatatgtaacacgtatcacggactgtcaaatgtctttttttttttagacaaggtctcactctgtgaccaggctagggtgcagcggtgtgatcttggctcactgcagccttgaactcccaggcttaagcaattctcccacctcagccttctgagtagctgggactatggcatgcaccaccacacctgggtaatttttgtatttttttgtagagaccagggtttcgccacgggcccaggctggatttttttctttatatgtaagaaaacttggtggagacggggtttcgctgtgttggccgggctggtctccagctcctaactgcgagtgatctgccagcctcggcctcccaaggtgcggggattgcagatggagtctcgttcactcagtgctcaatgttgcccaagctggagtgcagtggcatgatctcggctagctacaacctccacctcccagccacctgccttggcctcccaaagtgccgagattgcagcctctgccctgccgccaccccgtctgggaagtgaggagcatctctgcctggccgcccatcgtctgggatgtgaggagcccctctgcccggctgcccagtctgggaagtgaggagcgcctcttcccgggcgccatcccaactaggaagtgaggagcgtctctgcctggccgcccatcgtctgagatgtagggagcgcctctgccccatctgggatgtgaggagtgcctctgcccggctgcgaccccgtctgggaggtgaggagtgtctctgcccagcagccccgtctgagaagcgaggagcccctccgcccagcagccgccccatctgagaagtgaggagcccctccgcccggcagctgccccatctgagaagtgaggagcgtctccgcctggcagccgccccgtccgggagggaggtggggggcagacccctcccggccagcctccccgtccgggagggagttgggggccagcccctgcccggccagctgccctgtccgggagggaggtggggggcgcctctgcccggctgccccttctgggaagtgaggagcccctctgcccggccgccaccctgtctgggaggtgtacccaacagctcattgagaacgggccatgatgatgatggtggttttgtggaatagaaaagggggaaatgtgggaaaagatagggaaatcagattgttgctgtgtctgtgtagaaagaagtagacataggagactccattttgttctgtactaagaaagattcttctgccttgggatgctgttgatctatgaccttgctcccaaccctgtgctctctgaaacatgtgctgtgtcaactcagggttaaatggattaagggcagtgcaagatgtgctttgttaaacagatgcttgaaggcagcatgctcgttaagagtcatcaccactccctaatctcaagtacccagggacacaaacactgcagaaggccgcagggtcctctgcctaggaaaaccagagacctttgttcacttatctgctgaccttccctccactattgtcctatgaccctgccaaatccccttctgggagaaacacccaagaatgatcaattaaaaaaaaaaaaaagaaaacttggcaaaggatatggacagacaggaaatccagctggatcttcagcatataaaagatgctctaccacactggtaataagaaaactatactttaaaactacaagatactattttacagtctcagataggccaagttcaaaaatgaggagagtggctcgtgtctgggaggctgtggggtctgcgcggtcactcattactctccttatgccccctggggagatggcatggcaggcagtttaccttccaaaggtaacagttcacacactctttaacaaagcaattctgctcctttgtcctacggacttgcttgcatatgaaatggcctgccagtgagaatgtgcactgcaacgtggtttccagtagcgaatatgaaaccaatctacatctccataaataagagatgggtgagatagtgatgcattcacagaaccatgagtagccatgaaaaaaatgagtgtctttatatgaactaatatgcagagatctctaagaaatattattaaaggaaatgcaaggtgcagaactgtgggtacacctaccactaatgtaaaacactaaaaagcattgtgtaaggatataaaagaggttgctcatagtgttccttccagggaaagaaaatgggatgactgtgggagaagggttggaggagatttaactttcactttcaaactttttgctgtgttcatactttgtctattcaaaaaaattaacaaataaaaatgcatttaaaaattagaggccagtattacctacagtttccagccttctgtgtaaaagcagatgtattcacattctccagagaaacagaaccactaaggtatcaatatttccatatctctatatctgtctatatatacagatttattacaaggaattggaggttgagaaatccagaccccaggcagcaaatagtggtatgtgacttgccttcatcaacagaaaatgctggaagtgatgttttggggcttacaattccagtctttagagaattgttagcttctgcttctcctcttctagagtccagacaaggtaaggtgttaaactgtactgagacagccatgctgtgaggaagcccaagttatccatatggagagagagacaacataagggagcactgaggttctagacttgtgggtggagacttattggaccctctagcctagctcagctccatatatgtagtccatgccatgaggtggagcagaagagctgcccagccatgccctgcccaaactctcaacccacagaattgtgagaaacaataaattgttgtcttaaaccactaaattttggaatgttttgttgcatagcaataggtttgcccctaacatactggatgtcacaaggtgacaattcctttacagggacagctgagtgaccatcccatgggaaacaaatatttgcattcctttatcatgttactgaggcgacatctaattgtatccttctttttaccttacgtgagacactaatgggtggttttctccttgatcttttacagaagcaaacacagcatcaaacagcaaggggcttctaataggggatttgcagatggccagcctatctcagaataggacacaaagatcttggggtaccttgtttaggattcagacagtagtccctgtgaatcctatatacttgctatgaaaaggaaaaattggcttgtcaatttgaggtcaaaatggtggataggaggcaggactagcagctcctactcagacagagcagcacgtggagattcacatcatgaactacctcaagaacataccaggaaacctgagagaatccacagaccccttgaaggaggtggattgccactgcaggctccatgggacagctgaggaaactgccagtctgtttgctttctcacctggaaggcttgtagcctggggcaagttctcagccctgctcactggctgcctggaaataaactgagtgctgttgggggaccacagtgggagtgagatcagccttttgggctgtgggctgcatggcagctgggtgacgcctgtggctgccagctttcccccccttccctggcaacctgtgtgatgcagcagaagcagctataatccccttggtaacataactccattggcctgggaaccacacctccaccccctaaagcagcagtggcaggccccgcacaaggagagtctgagctcagacatgcctaaccctgaccagacctgatggtctttctctacctgccctggtaacagaagacaaaggacataatctcttgggaactctatggccctgcctaccacctgaccttagggcaagcttgtatcctccctatactactgcagctgatgtgctcttaaaagcaccacctcctggctggaggccaaccaaaacaaaactagcaccttttgttgttgtcattgttgttgagacagagtttccctcttgttgcccagactggagtgcaatggcatgatctcagctcactgcaacctctgcctctcaggttcaagctattctcctgcctcagcctcccaaagtagctgggattacaggtgcccaccaacgtgcccagctaatttttttgtatttttagttgagacggggtttcaccatgttggccaggctggtcttgaacgcctgacctcaggtgatccacccgcctcggcctcctgaagtcctgggattacaggtgtgagccaccacacccaaccaaaactagcacacttaataaaaatacaaccaaggaccctcacagagtccaggcgctggtatccacagctgagagacctaaagacggatcacatcacaggactctttgcagacactcctcagtaccagcccagaggctggtagctcttctgggtggctagatctagaagagaaataccaatcactgcaatttggctctcaggaagtcctattccaagggtgtgggggagagcaccacatcaagggagaaccctgtgggacaaaggaatctaaacagcagcccttgagtcccagatcttccctctgacatagcccacacaaatgagaaggaactagaaaaacaattctggtaatacaacaaaacaatgttctttaacaccctcaaaaaatcacgctaacttaccagcaatggatccaaaccaaaatgaaatccctgaactgccagaaaaagaattcagaaggtcaattgttaagctaatcaaggaggcaccagagaaaggtgaagtcctacttaaagaaattttaaaaaatgatataggatatgtgataaacatcataaaaaatgatataggatatatcatataagatataggatatatgacaggttttccttcatacgttacctgatacttttgcctcataactcttaagattctttccttcatcttgactagataatgtgatgaatatgtgccaaggtaatgatctttttgtgatgaatttccaaggttttctttgagcttcttgtatttggatgtctaggtctctagaaaggccagggaagttttccttgattattccctcaaatatgttttttaaacttttagatttcttttcttcctcaggaatatcaattattcttatattttgtcacttaacaaagcaagcactagtagctattcttacatcagacaaaacaaactttaaagcagcggcagttaaaaaagacaaagagagacattatataatgatgaacagactagcccaacaggaaaatatcacaatactaaatatatattcacctaacacaggagctcccagatttataaaacaattactactagacctaagaaatgagatagacagcaacacaataatagtgggggacttcaatactccacagacagcactagtcaggtcatcaagacataaggtcaacaaagaaacaatagacttaaactataccctagaacaaatggacttaacagatatttacagaagattctacccaacaactgcagaatatagattcaatgcatcagcacagggaacgtactccaagacagaccatatgataggccacaaaacaagtctcaacaaatttaagaaaatagagattatatcaaatactctctcagaccacagtggaataaaattggaaatcaactctaaaaggaaccctcaaaaccatgcaaatacacagaaattaacctgctcctgaatgatctttgggtcaacaatgaaatcaagatgaaaattaacaaattcattgaactcaacaataatagtgaaacaacctatcaaaacttctgggatacagcaaacgcagtgctaagaggaaaggtcagaagttcagagtgttaaatgcctacatcaaaaattccgaaaaggcacaaatagacaatctaaggtcacacctcgaggaactagagaaataagaacaaaccaaaccccaacccagcagaagaaaagaaataaccaagataagagcagtactaaatgaaattgaaacaacaacaacagaaaaaatacagaagataaatggaacaaaaagctggttcaaaagataaataaaattgatagaccattagtgagattaaccaacaaaagaagagagaagatctaaataagctcaatcagaaacgaaacaggagatattaccactgataccacagaaatataaaagatccttcaagggtactatgaacacctttacacgcataaactagaaaacctagatgagatgaatacattcctggaaatacacaaccctccttgattaaaccaggaagaaacagaaactctgaacagaccaataacaaggagtgagattgaaatggtatctaaaaagttaccaacaaaaaaaaaaggtctacgaccagacgaattcacaactgaatatatatcagacattccaagaagaattggtaccaatcctattgacactattccaaaagacagagaaagagggaatccttcctaaatcattccatgaatccagtatcaccctaataccaaaaccaggaaaggaaataacaaaaaaaagaaaactacagatcaatatccctgatgaacatagatgcgaaaatcctcaacaaaatactagctaacagaatccaacagcatatcaaaaagataatccaccatgatcaagtgggtttcatactagggatgtagggatggtttaatatatgcaagtcaataaatgtgatacaccacataaacagaattaaaaacaaaaaccacatgatcatctcaatacacacagaaaaaacatttgacaaaatccagcatctgattaaatgctcaaatgattaaaaccctcagcaaaattcgcatacaaaggacatacctcactgtaataaaataaaatattatcactgtaataaaagccatctatgacaaatccacagcaaacataatactgaatgggaaaaagttgataggattccctctgagaactggaacaaaacaaggatgcccactcttaccaatctattcaacatagtattggaagttctgcccagaatattcagacaagagagaagaataaagggcatccaaatcagtaaagaggatgtcaaactgtcactgtatgctgatgacatgatcatatacctagaaaaccataagggctcatccaaaacgctcctagaactggcaaatgaattcagcaaaattccaggatacaaaattaatgtacagaaatgaatagctctgctatacgccaacagcgaccaagctgaaaatcaaatcaagaactcaatcccttttacaataggtgcaaaaaataaaaataaaatacctagggctatacctaaccaaggagatgaaagacctctacgaggaaaactacaaaacactgctgaaagaaatcatagatgacacacaaatggaaacacatcccctactcatgaatgagtagaatcaatattgtgaaaatgaccatactgtcaaaagcaatctatagattcaatgcaattcccctcagaatatcatcatcattcttcacagaactaggaaaaaatcctaaaattcgaatgaaaccaaaaaagaccatagagagccaaagcaagactaaacaacaacaacaacaaaatctggaggaatcacattacccaacttcaaactatactgcaaaactatagttaccaaaacaatatggtactagtataaaaataggcacataaaccaatggaacagaatagagaacccagaaatacagccaaataattacagtcaactgatctttgacaaagcaaacaaaaacataaagtggggaaaggacaccctattcaacaaatgctgctgggataattggcaagccatatgaagctgaatgaaactggatcctcatctctcaccttacacaaaaatcaactcaagatggatcaaagacttaaatctaagaccagaaaccataaaaattctagaagataacattggaaaaacccttgtagacattggcttagatatagacttcatgaccaagaacccaaaagcaaatggaacaaaaccaaagataaatagatgaaactgaattaaactaaaaagcttctgcacagcagaagaaatagccagcaaaataaacagacaacacacagagtgggagaaaatattcacaatctatacttctgacaaaagactgataaccagaatctgcaaggaactcaaacaaatcagcaggaaaaaacaaacaaacaaacaaacaccccagaattgggcaaaggacatgaatagacaattctcaaaagaagatatacaaatggccaaaaaacatatgaaaaatgctcaatatcactattatcagggaagtgtgaataaaaaccacaatgcaataccgccttactcctgcaataatggccataatcaaaaaatagatgttggcgtgaatgtggtgaaaagggaacacttttacactgttggtgggaatgtaaactagtacaaccactatggaaaacagtgtggagattccttaaagaactgaaagtagatctaccgtttgatccagcaatcccattcctgggtatccatccagaggaaaataagtcattatatgaaaaagatacttgcacacgcatgtttttttttgttttttttttttttgtcttttaacagccaacagtttattgtacactagtcttgagcagcttcaatctgaattcatctccccaggacaggaagaagtcaggagatctcggggagacagagcttatatcctttcttattcagaactgccacaacccctatccctcaccagtcaggccccacatcacaccagtggcccagctggaattctaacatcagctaattcctttatattcttgtcgttcttgacattgccagaaaacgtaatctctcatgctttccaatcccaatagtgttttctctgggcctcctaacccccctctctgtccacaaatctccttttcagttgcaacccccatccaattttaaacaacttccacattttcaatactgaggttaatcattaattgagctgtaatgggtatgtgttgtctactaagtgttttggaaagtcactttgacacttatctaatattataggcatgcactcatccttcccatgacccttttccttccacatactttagaatgttcttccttgataggaatgtaagctctatgagggcatgtgtttttgttttattcactaatgtggatcaagtaaccatagcagcgcctctcgtatagtaggtattcaataaataagcattgaataaatgaatttaatgagcatacattcagcaaatatatggttatatgacaatatgacaatgaatgagtaaaataatattttcccttatggagtttacattctaatgtgtaaatgccggaagcctatgacaaacagacaataagcatgtaaacagatataattccatactctcattaatctatggggaaaataaatcacattagggaaatagagaatgactggtagaaagaattttggttattttagatagactggttaagacaattctccttggggaggcaaatctgggcagaatactgatgtgaggcaaaatgaagattttggacataaaaagacttgggaataggcaggagtaataaacagagaatataaagatcttgatatggcaaaatgttttatgcatttgagagaaagagtggttggagataatgttagggagatgaggaaaggccatgttgtacaggtcttacaggttacctatacctgggggtccctaacccctgggccttggacggataccagtaccggtctgtggcatattaaaaactgggtggcacagcaggaggtgagcagcgggctagcgagcattacctcctgagctccgcctcctgtcagatcagtggtggcattagattctcataggacaggaaccctattgtgaactgctcatgcaagggatctaggttgcactctccttatgataatctaatgcctgatgatctgaggtggaacagtttaatccccaaactatccccacactgtcccttcccacagaaaaattgtcttccttgaaaccagtccctggggccaaaaatattagggaccactgatctataggattttcattttatttaaatgtgatgtgaaagcatgggaaagtttggaaaagtctcatgatcttatttaggatgataaaatcatgaattaaaaagctacttggtggagagagaaagcaaagagaccagcaaggaggctattgtagcatcaagtgacaaatgatggtggattgagccagaatggtggcagtggagtggaatcaggttctggatattctttgaagatggatttgatatggtaagggaaggagaggaattaagaataggtcctagattcctcagctgagctgggaaaatccattttactattagtgtttcctcaggaagagaatgagctaatacatttggggaaaatattatcacttcctgaaaactgaaaagaaaatgatcattttttaaaaatctattgtatcctttgttttctcttaacgttcttttgtctcccagccttttattttgaaaaatgttaacttcaataagaatttgaaaaaaatagtacaaccatataccctttacctacgttcactaattattaacattttgctacatttgctttctctgtcttttcacatatacacacaaacacacacagtttttctctgaaatatttgaaagtatgttgcagacatcatgaaactgcactgctagtattttggtatatatttacacatatttactgagaacaagaagattttcttatagaaatacaagaccagagaaattttacatagctacagtgctttttttttaaaatttatctcccactatctctttatttatttatttatttatttattattatactttaagttttagggtatatgtgcacaatgtgcaggttagttacatatgtatacatgtgccatgctggtgcgctgcacccactaactcgtcatctagcattaggtatatctcccaatgctatccctcccccctccccccaccccacaacagtccccagagcgtgatgttccccttccagtgtccatgtgttctcattgttcaattcccacctatgagagagaatatgcgatgtttggttttttgttcttgtgatagtttactgagaatgatgatttccaatttcatccatgtccttacaaaggacatgaactcatcattttttatggctgcatagtattccatggtgtatatgtgccacattttcttaatccagtctatcattgttgggcatttgggttggttccaagtctttgctattgtgaataatgccgcaataaacatacgacacatgcatgtttatagcagtataatttgcaattacaaaacatggaaccagctcaaatgtccatcaatcaatgagtggataaagaaaatgtggtatatatgtatatataccatggaatacgactcagccataaaaaggaacaaaataatggcattcgcaacaacctggatggagttggagaccattatcataagtgaagtaactcaggaatggaaaaccaaacatcatatattctcactcataagtgggagctaagctatgaggatgcaaaggcataagaatgatacaatggactttggagatcaaggaaaagggtggtgggggtgggggataaaactctacacactgggtacagtgtacactgcccgggtgatgggtgcaccaaaattttagaaatcaccactaaagaacttattcatgtacaataaataaataaataaaaattaacagggggaaaattggtacatggaatgtcagggggccttaggcaacgctgccctggggcagaaccccctgctctcccaccaagacacagtgccctccccaaccctatcaagcagctggccctgaaggaacagtgtacacctgaggggcccaggcaggaggctggagcttagggcataggagaggagccaagaggttgtgaagacagagtagctgcaggggaggtgcagactccaccacctaaagggtgcctgcaggggcctgagagccaagaccaaggctctgcaccatggggtggcctcctgcatctcccgccatgtggactctgcacaggttggattatatcccttgaacctgaagagccgccttaacattttttgggattccatgtttgtgctgacaacaccaccccttccttccacaacactgggcatggtgcccaacttggaccatgggttgtcaatcaacgagtggatgatcagccctcaggccaagtcctcccacaccctgtgtttgtgaatacaatgttattgatcaaggcagtgcacattgatgaaactgttgtccacacctgccttcacgctgtaacagcagggatgagttgttgtgacagagaccatgtggtagcaaagcctgaaatatttaccctctagctctttacagaaaggattgtcaatcctgaggaaatcaacaggaaggaaactattccagtttctaaaaatgtgagtgttttgtgtggtgaaagagaccatacatttctaagagaaatgatagagacagactggagaaaatacttgcaacatatgcatttacaaaatttaataactcttggctgggcgtggtggctcatgcctataatcccagcactttgggaggccgaggcagctgaatcacttgaaccccggaggtggaggttgcggaaagccgagattgtgccactacactccagcctgggcaacagagcaagactccatctcaaaaaaaaaaaattaataactctaatattccaaggcttctacaaattaatgagaaaaaggcaaacacaataaaatagaaaaatagaaaaatgggcaaaggagttgaacagaaaaagcacaccaaatacaaatgatttatgaatttatgagagacaaatgtcataagttattaagaaaacagaaatgtcacagtgtttttcactcacattgatagtattgagtcttgataaggatgaagggaacgctgtgcctttgggagaagcatcaatgagcacacttgttttggagagggtaatctatctaaactaacactaaattttttaaaaatgcatatctttgctagatagtatcatttctagatgtctaatctatagaaataatcatacaagttcaaaaataaatacagaaggattgtcatcctatcattacatgagataacatttttttagagaaaacctgaacactaattaatggaaaatggttacataaattgtaatgcatacattttgtaaaataggcagttattaaaaggaatgaaatgcatcaatattttctaaatgtaataactactaagatatattgttgagtaaaaaagcaagttgaaaaacattatgaattgcatgattgcattctaaaacataaaatctgtgtgtgtgtatgtgtgtgcacatgtgtgtgtatgtgtgcatgtgtatgtgttctagggaaaggagcgatggccacctacctccttcactggtgtgtggtaggcagggttgctgctctataagctaagatattgatttggctgctttagcaaagatcaaaataacagtgacttaacaataaagaagtttggttctccctctcgttaaagtcttggattagtagaaaggccagaggtcaaagtttccagagtcctacctgtctcatcactgtgccattctgtcagtgcatctcagctccacacagttgcagctggaggaccatggcctgggcagcaggaagggggaatgtggaggaaaggacagataggctctgtggaaggcatgacccagagttctacatgtgatttaaatcaccttcttttggccaaaacatagtcatgtggccacaccacgtaggctgggaaaaaaagcagtccttggctaggcagccccatgcccagctaaaatgtagaggtatctgttattaaaagaaaaacagaagaagtcaatatttgggtataatgagtagtctcttcctatggatgtcctgctgtcttccttgccaacagaaaatcataaaatcgacaatggagaaacagcagacggattatgaaagaatgcaatttgtctatagcagacttatccacaacagtaacaggcaacagaagatggaaaattatatttgcaaagtaatgagagaaaccagtgtgagcatagcatcctacattatgcaaatgatcatttaagaggaagggaaagagaaaaacatttcagagcaagacagtgagaattggccaggcacggtggctcgtgcctttaatcccagcattttgggaggccaaagcaggaggattgcttgagcccaggagtttgagaccagcctgggcaacttggtgaaatcctgtctgtattaaaaacaaaacaaaacaaaacagaaaaaaaaaaaggtagtgagaatgtaccattaatagacatgtgctgaaagaactactaacagatgtactatatttcaagaagaaggaaattgaacacagaaggaactgaggtgcaagaagtaatggtatagaagaacactggaaatatatggtatttctagaaagctttagctgaatccatcagtaataataaacgtaatagttctgaatgtataaaagtaagttggaaatttccagctggaaaaagatggcttagactagttttccttgcaccttccctctacacacagctataaaccctagaataatgtaagaggcaaccaaaggagaactctcataggtgttaacaggaaagtgaactggtttgggcctcagggatggatgaagtgcagctgcagggaatcttatttccccttaccagatggaggacagtgacccaggtccagtgtttcccatccccaacacagtgacagaaggcagccaaggaatcctcattcctgtcctggaactacaggagtccctcctacagcaccaggtgtattcatcttctgttgttgctataacaaaattaccacaaacttagtggcttaagtaactacacatttattattttccagttgtggaggtcagaggtctcaaactggtctcactgggaaaaactcaaggtcttcagggctgtattccctttggagctctagggggggatccattcccttgtcatttccagctttagaggctgcccacactccttggctagtggccccttcctccatctccaagccagccacatcatgttgagtcctgctcattcttccatctcttattttctctctactgccttcaccttccattaacaagaactcttgtgattacattgtatgtttgtggttacactacagaatccaagatgacctccccatctcaaggtcaactaattaacaccttaattctatttgcaatctttgtcattaccataacatattcatgggttctgggataaggggtagacatttttatggaggcattagtctgcttaccacagactgccctctggcccccaaagatacacatctatcccatatgcaaaatgcattccactccaagattcccagccttatcaacccattaaagtaacaactcaaagtccaaaatctcatctaactttcagattagctccaaagtgccaaaatgcatcatccgaggctctgggagtgatccatcctggggcacaattcttcttcatctgtgaacctgggaaattcaagaaacaagttatctactcccaaaatacaaaggtgagacaggcatgggataacagtgatagatatttccattcaaaaagagaagaggaagaaaaaggagttgccagtcccaatcaatttcaaaatcaagccaggcacattccattttgtttcaaggcctgagaataattctctgtggctcaagactcagacccccctgagctagtggctctgcctttggagtcatccttcctttttcttgaagggtatcacatgtttacagctgagtagttttatcatcacattttttgcctgtagaatttgagagtggcgggggcggtctaacagccctttttcattttgctttctctctgtacttttctttccaagctagcagtgtttctgttggtataacatcctcaagagccttgtgagtctcccatgtttgtcacagggattcacaccattggataagagactcatctaaggatctttcatagagttcagtgccacctgcaagggagatataccaggatcccaccatcaataagtgggcaagagaagtcctcacctcctctgcagcctgaaactcccctctcccatcaagaaacagcaggccaggtggagaaggcactggcagagggcatcctgtcataagtacctcctctgggaagactctctgtgccctataagcagaagagatcctgtcacaagggcccagcttggaaagcctctgtttttgtgtgggcctgggtcttcccaccccactgagtgacaccaggccaacaaacctagggaaataccttcagccctctgggcagcaacagcagggaccagtgaagagcctagcagcaccagctaaaccaaacaggtgaaaatgacaccacaaagtttctgaaaattaaactgttattggaaccatggcccacaaaagtaggtcattactcacatactaagccttaacagggtgattgccttgctacaatagaaaatttaaatagaaatcagtctcctaacagaagaaacaaaatgtccagaatacaataacataccaagaaacaggaaagcaacaacttgaatgagaaaagacaatcgaataatatcaacatggagacgaattaggtattgaaatattctggctaggactttacaggaaccatcataaaaatgcttcaaaaattaattacaggggccgggcaggtggctcacacctgtaatcccagaactttgggaggccgaggcaggcggatcacctgaggtcaggagttcgagaccagcctggccaatgtggtgaaaccccatctctactgaaaatgcaaaaattagcctggcatggtggcaggtgcctgtaatctcagctactcaggagggtgaggcgggagaacctcttgaacccaggaggcagaggttgcagtgagcagagatcatgccactgcactccagcctgggtgacaagagggaaacttcatctcaaaaaaaaaaaattaattacaaatgaaaaaatagaaaatatcagcaaaaagtagaagttacaaatttgttgggttaaattacattaatagattttatgatgtagaaccatcatttattttattgtaaaaatacaataaaataaattaaaaacttgctggatgagctcaatggtagaatggaagtgacaaagcataaaatctgtgaatatgagaacagatcaatagcacttgctcatcatgtgaataacatcattaagaataacagaaaaaaaatcatctgaaaaaaatgaacagagcctcagggaccttgttagagtaaaaaaaaaaatctgacttccatactatcagagcctaataagaagagaagaaagagttgaaagaatatttgaagaaataattcccattttgatgaaagatataaatctacagattcaagaaactatgataatcacaaacaagataaacccaaagaaatccataccaagacacatcatcattaacttaataaaactaaagacaaaaaaaattgaaaacagccagaagaaatgacatcttaacctacaagtgtcatttgaataagagtggatttcttatttgaaaccatggatgataaatatcttataaaacataaagtagaacatattttacatagactatagtctcttataaaaataaaatataaaagaaaaatctctttgcactcccatgttcaagggtggaagaagagggatgtcccaggggagggaaggaggaagagaatttgcccttctcccacctttttgttctatcaggtcctcaacagatgggaagatgcccatccacattggtgagggtagatctttactcagtccaccacttcaaatgccaatctcttctagaagaactctcacagacacactcagaaataatgtgttaccagccatcagggcatgttttaggccagtcaagttgacacataaaattagccatcactgtgtacttttcctgccctggtctttgatttggcctagtggtgatagggaatttagaaccccagatccagtctctagctgtgctcattgctcctggagcaccatgcttctggctctttcagaacagaagtagaaaatatatgagtttttcatttgtttgctttttaaatctatcctgttccctcaaattctaaccaacaccacagtactcttccggtcttagagcttcaaacttatgtttgttttatctgaattccttcctcaggaaaggaccctcaggcctgtcaacgaaagtatcaaagaactgaaactcacaaaatcaccacatcctgataatgagatgccagacccctcattcatcatgattgcttccttaacctctctaattcctgttttcttatacattattacatttcttcccaggtatataaacctttaattttggtgggtcaggcagaaggatttgagactgaactctcatttccttggctacctcagtgattggctgtgcagcaagcagcaggacctcagtggacccctggtgttttggtaacataatcacatcatatttctccttcaatttattgggttaagttacattaatagattttatgatgtagaaccatccttacattcttgcaataaactgtattagttgtgaattggtggattcgactaatatttcattcaggtttataaataaaatgtctgtaattatcacttctgatgttgttcttaactggttttggaatcaaaacaatgttcactttttagaatgaacttgaagacgttatctcttttggtatattttggaacaacttgcttaacttgaacatttgtatataatttgaaaattttgtaaaatttaccttcaaaaccattttggcctggggttgtttgtttgaggggttgacggaaggcagagcttggactattacaactgtattaatgtttcctggtttacctgttccaatttttttcttcttatgcagttttggttttctatatttttataagattttattcattgaattgagggcttcaatttttcatttacaataaaattctcctttacaatttttaaaaatctccactgtgtttgcagttattatctctttttgttctgtatttcctctcatagtttacttttatgatcatcttttttccttggtgagtcttgtgagatgtgtctgtcttgttaattttttcaatgactttatttctgccttcgttaatcttctccattgttttgattgatgtgtgccctgatggttattatctccttttgtgtggttttttttttttttttggttttactttgttgctcttattccaactcttgagttgaatgctagtttgtttttaaaaattgtattttctgaaaaatggtcttaaagctataattctccttctaacaattgctttattggcagtctgtgtttttattatcatttagttttaaatattccgcaacttccttttaaatccaagagtgattttgtaaaatgctatttatttccaaaaaaaaaaattggattaaaaatctcttttgggccaggcacagtggcagcactttgggaggccaaggcaggtggatcatgaggtcaagagattgagcccatcctggccaacatggcgaaagcccatctctactaaaaatataaaaattagctgggcatggtggcacatgcttgtagtcccagctactcgggaggctgaggcaggagaattgcttgaacccgggaggcggaggttgcagtgagctgagattgcaccactgcactccagcctggtgacagagtgagactccatctcaaaaacaaaacaaaacaaaaaaactcttttgttgttttagttgtattatatttaggaaacatgctttgtgtgaaattcatcctttggaatttaagagagctttccctatgttctaatgcatggtcaatttttgtacatgttccttgattgccctaatttaatgtgtattacctattttggggggtttagagttctttatatatctattaattatagtgatcagaccttgatacgcatgctaattttttggtctgttttatccataagtttctaaagcagtatgttaaaatatcctactataattattgattcttctatttatatctataattttttcagttgttaccttacatattttgttgctataattgtggggacacaatttcatgatgttgatgtgtatattttgtatttcttttaagtagtttaaatatcattattctggaaattttatcctaaattttattagaaacatacttcattgtttctaagtcaagatttttacaaattctggcatctctaaaactgagttgctgagttgctaattaatgaggataaagttctagttaaacaaaatgaataagttctagagatctgctatacaacattgtaacctatctttaactataccctattgagccataatccagccactgtactccagcctggcccacagagcaagaccctgtctctaaaaaccaacaataactacaacaacaacattgtattgtacactttaaaatgtgttaagatggtatatttcatgttaagtgttcttatcataataaaataaaatttcaaagtaaaattgagttgtttcttttacctgctgtctgggaggcagtagatgtgacctaggtgttattgcctgtgtttatgtgaacataatgataactgttctttttgtcattacttcaattgagttctgtgcatttttggcactagatgtgctgaatttaattgctgtttataatttatttaaaagcttacatgatgatttggcattgaagtgaaaagttatatcgtaagcagaaaattaactataagaggctagtgtgacctatttatatgtcatgcaggactatagtcaaggtatcaaatatcgatttgtcagaaacttgctgctgactttgatctgaagctatttaacttctaagaacatatgattccactgaggaaaaaaatgaagctatgaatgaaataaaaaatgaaatactaataaaactgagtttttacagaacaattgctaaaggtgcttattatgaacacaggttagaaaaatattacatcactctgatgctatgcataatcaccaaaggtcaaatgttgttaccatatttaattttaaaccacaaacaataacaaaatgtaagttatttcccaaaatatcttattgtgcttgcactaaaaagaagaaaaaggcattagataaactgatgacagaataattaaaagaggctgggcgcggtggctcaagcctataatcccagcactttgggaggccgaggcaggtagatcacctgaggtcaggagttacagaccagcctggccaacatggtgaaaccctgagtctacgaaaaatacaaacaatagctgggcatggtggtgggtgcctataatcccagctactcaggaggctgaggcaggagaatcacttgaacctaagaagcagaggttgcagtgagccaagatcgcaccattgctttctgggcaagagagtgagactctgtctcaaaaaaaaaaagaaaaaaaactcaaagaatctggaatggatgtctaggagactaagtaactaagcatatttgttttgatgtatctgatcagctaaagaataagttcactaagaagtgaattaggttggtggttgttccataatgtatgactccttgaagattccatcagcaaaccatttaacacttatttgaagaaggaacacgatttctgtttgttgtctgaaaaccttgcactgattgcaagttctggtaagatcactaaagcactggcatcaacttaaaaatggcatccatgtcttgaaagaaaaaaaaatctcagacaacattgaagcactcttaaacagtgcttcatcacaaattctatcattatcacagagggcatttgagtatgctcaaaagcttgggtaactgactgtgagtgaaaaagtaattcaaaagaattatattctgatttggaaaagtttgttttccttttatatattagggctatctatttccagaatttttaatttaattttactttaatttttttagacaaagtctcactctgtcacccaggctagagtgcagtggcacaatctcggctcactgcaacctctgtctcccaggttcaaatgattctcttgcctcagcctcctgtgtagctgggactacaggtacccaccatcatgtccggctaatttttgtatttttaatagagacagggtttcaccatgtttgctagtctggtctcaagtgatccacctgccttcacctcccaaagtgctgggattacaggctagagttttatttttaattctaccgtctctttaagtttcttctggagaccacatactgttggatatgtttttgtttcaaattctgagagtctcagccttttaattgttggatttaacccatttatattttgtaatttctgttatattagtgattatttcttccaacttcatatttacatttactttttcccattatattcttttattgatttaaaagttataactataatttatgttctatgacagttgccttaatttaatatccaaatatatgtttatttgcttcttttattttcttaagcaaatattaatatatacatttttcccttaacaataaaagtatttttgatgcttattatacccttggcctctctttcttgctctctcaatccctgtcatattgatattatttaaaattttagttcttggttgccatatatgtttttttcttttctttggtcttagagtgagggcgtttgtacttttcttccctcctaaggcaagggtaacacttgctgattcatctgaggatgcttattgcccatacctcccgtattatccttctgaatctgtagctcctcttttttatgtactttccttgaaaatattttaaatgtgagtctttgttgatctttgtgtggcaagcctgatactctaaatgcctgagcacattttaaatatatacttaggttttaatgaaaaattggagataaaaatttcagtttcaaaatttttattttcaatactttaaaatatttctcagttgttctattgcttccaatgttgtgtttgagaagtttgatgccaatttgattcttattcctttgtaagtgctctctgcaagcatttagaattttccctgtctcctaaatgttttaaattcactgtaatgtatctgggtgtgtctttttctttatgttttctgtttgagccctatttgtctttatttctgggacattcatctttgcttttattcaaatatttctttttctccctctttctctttttcttttgagactccatttacccctaccctttggatattggcacttctatatctatcttccatatcttttatcttatttcacagttttaatctctttattctttcctgccctctgaagtgttctcagccttcactctcaattccctaacctgcttctcagctctggctcactctagaaggcccatgtcaatagacctgtccgtggttttctaacttttaccatcacacatagcactgcagtgaataacctgcacatgtgaaaggatctctataggataaatgcccaaaatttgaattgtgagtcaaaggacatctgaatttctaatttctgataggtaaatttttctccacagtggtggaccgaattacactccacccagcaatgtgtaagagtgtggtttcttttacattttcctaatgatgaattgtgttgaacattgtttcacgtgtttattgaccatctgcatatcttctttggtgatatctattcgagtcctttgcccattaaaaacattgagttgtcattttgttattgggttgttaattcatattttctacttaattgttgcttttatacgtgaaaagctgtgggtctcaatattaattttgttcattgctactgtagtaaattttcttattatttgttgtactttttcactgtgttggatttttcaggcatgcaatcatgttatctgcaaataggctagctcctctttactgctgtttctcttgtctataatactcgtgttggctggtacctctaatgcaatgttaaataacaatggttacaggagacattctcgttttgtttctgacactctcaggaatccttctaatgatgtgaatttgcggactggaatagatttatattgataatgctatgaagtattagtctatattggcttatttaagatattaaaatcagactagatttaagttttctatggtctatggaactgatcatatgacttatctctttagagccaatgattttgtgaattatattaatttcctgacattcagtcatcctattattcctggaataaattctgcatagtcataaggaacacattcttattctaaggcattgttatattctgtttcctaatattttatttaagatttttaaattggaattaataagcaaaattggtgtgtatcttccttttctgtgtctatactccctgccaaatttcaatgttacttttatgtcacagaaaacatttagaagtttttctcatttttcaatgttttgtagcagtttaaaaaacacagaaaatgtctgttatttattaaagacaatgtaaattcccttataacattatcaaaggctattctggagactagcttattgacaactatattagtctgctggggttgtcataacaaagtatcacaaactaagtggcttaaacaacagaaatttattgtcttacagttctggaggccggaagttgagatcaaggtgtcagcagggctgtgctctgcggagaatgctggggaaggatctgtccaggactctctccgcttctggtggttccttggcatgtggcagcatcactccaatcagcatgtggcatcctccctgtgtgcctgggtctgtgtccagacttccccttttcagaaggacaccagctgtgttgaatgacagcccacctggctccagtgtgacctcattctaacttaactaacatctgcaatgaccctgtttccaaatgaggtcacaatctgagggactggggcttaggacttcaacgcaggaattcgggggcatacaattcaacccagaacaacaaccttatccatgtcttcactctatttaaacttcctaactcttttggagctcgttgtgataagttatatttttctaagaaactatccatttgttaaatgttttcaaatatagctgaataaaatggatcaagttaatctttatgattttattttctgttgctttttcctctgcaaaaataaataattaatttttaatttttgtttctggttatttctcccttattgttttttctttgtggtgtttaaaaagctattttgcttatattatttagcagtttacacattccaccccaccccatcccccaaccatgaacttttgtatttatttctcaattgtactgttttttccccaaatcactgatttatatttttctttgttaatgcttcctttatgctttctttcagtttatttttctttaaatgactaaatgtacttattttaaaataattatacagtaaaattgacattttttactctttgaaggtaaagtccatgaattataacatatatacattcatgtgactactgccatcaccacggtacacagttgttctatgacctaaaaagaaaacccccaaacaagaaaacttcgtgtgctgttgacacgcttgcccggtcccggccccatcccccactgatctcctttgctgtcattctgttctcccccactgtagttttgtcttttgggcaatctcatgctaatagaatcatcccgtatataaactttggagaccactactctcacaagcacagtgcctttgagattcattcagattgttctgggtgtccatacaggccagtctctgtggggctgctgcacaccacaccccctccccaccagcccacctctgagtgggccaagggcccagggtctatttcctgatagaaatctcaagcaacaagagtaattcctgacaagtgcccatttccttccctcatgacaagatgcacaatttatcttccgggaaggaacgcccagcctttggcataactttcttaagactcccaatctgctaattcatttcaagagaaaggaaaaaccctttgtttccaggtgagtgctgggagtgtggtatgatggggattcttcagacccaggaagtgacctggccaagggtcccctggtcttctccatccttccttccccaggttgccccctgctctctgacccccttcgcctgattccagctgtgtttttagtgctccctgatgttcctgcaccctgagaccctcaaccaccccacagtacaacagctcctgacacaccccgcagggcttttccatttttaggtggctcaaccctgctgcagcttttaactctgctagccagcaatttttttttcttttctttttttttttttttgagatggagtcttgctctcttgcctggagtgcagtggcacgatctcggctcattgcaagctctgcctcctgggttcacaccattctcctgcctcagcctcccgaatagctgggactacaggcgcccaccacctcgcccggctaattttttgtatttttagtagagacggggtttcaccatgttagccaggatggtatcgatctcctgacctcatgatacacctgcgtcggcctcccaaagtgctgggattacaggcgtgagccatcgcgcctggcttttttttgtttgtttgtttgttttaccacaaatgtcatacaggctggttgcaagaaaatgcaagtaacacataaatatattaagtaaaatataaattgtgctttcactgcctgcctccaacaccaaggtccatttcagaggtgaccactctttatggacagcttgagatatgtgcttccagattgttttgtgtgcatctgcaaagacacacacacacacacatccctcacacacgtgttcacacatacccctgtacttctgtagtagactcttggtgctgtgtagattttcttcatctggctggtgcatccttcccagctgcaccctactctggagactcaaccagggcagaagcaatctgtctcatccagaaatgtctggaagtggtacccagcccgtagagcagcccctagtcagccactgagtaatacaggcacaaaatccccgcccccttgcttggaggtggggccgctctgtggtagctttcgcattccagagctcccctgggaccaggctgaggcttccactggatcccttgcccggcttctcccctgcccttctaagcttcccctgagagcactttctcagcaaatctcttgcacataggcctgtgtaataggtatgcataggcacacgtagctgttctcagagaggagctcctgctcactgaagcagagggtggtgtctttcttcacatgacagcaccccatggccacctctgaatgtgagtctacttcactttcttatggcagcagagctccccctggaattgattaatagccctattagtgagattgagctcattcattcattagacacatggtttatgaagtgctactgtatgccaagtactgctttaagcactggggctgtctccaacttttctctcttacagaagatcggaatatttttaaagcatattcaagcatttgtgtaaatggttctgaagcacagattcctggagatggaattgtgggtcagagggaaactgcatttgcagccaggatgggtgtctcttggggaagtgttcctccttcagctccagcgacagctccttgctttgtgtctacttttctcccccatctctgccttggcaacctctcctccccagcccttcccacctacccagggaacacctgaaaccctggcagagctgctgctgagccctcccccatgctgctgatctgggcatttgcccttcctgctgcctcaggccctcagaaaccaaggcctcccagcctgtcttctctctggtccctggtttacggaagaggatgttgggattcagagaggttaagtgacctacttttctagaccaatttgttcaagttcctcccaaacatctccaccagcctgtcccagaggcacttcaaattcagcatcctggattattctcttcatgtctgccctaaaacttgccttttctgttccctataataaatgcccaagagaaaatgtcccatgacagctgactctcccacccctccttgtcaggcacaggtctcctgagctctcctgagcctgtctcctgggtctgccattgtgactgtcccctgcagccctgatctggatttgtggccaccagctcccttactgcttccaccagctggacatccttggtcctcacaggccctggagagttcatcttccagggctgctgtcagcatccccccttggctcaagcagcccgccggggactcaggagggccggtggcaccagaggccagcgcagtccgactcaggtcattccatgcaggcgcctttcaggtcctcaggacctggggaccagcaccacacacagctgtgggtcctctcgagccaataccatgtctcagcccctgtagcctgccccgtgctgccctcctcttacctcgcaggacctcctttcttggccccctggatagctgcctcttcctttccaggacagcctgggactctgggatttgccaatatatgtgtggggcatcagaggagctgagtgctgcctgtgaagggcattgacgacgtgtcggggaaatgggaaaggatgggagggtagacatccgggttggtgtcctagagatccaagacgcgcagctcaccatgctgcttgccttcaggtgcctcattggtaagtcaaaggcaacagatagaggctcccagaaggcccttcccagagagcaactctttagagatctaagcatcttcggagaaaatttgggagcttggatggtttgtatcaggcctctgttttttcttggactcttttgggtatcttcatgcccctcgagtgcttatcaggatgccacacggcacagcaggtggtgaatatatgtgtcataagtgagcgagaagcaaggcttttcatcagggaaagtatgacttctctgatggagcaatgtcactccattttacttacctgcaggaatgtttaacacgagagtgaccaggacactgcaagtggctgtgttagttggtaaaccttttcagaggacagtttagtaatccatatggaaagttctaaaattatgcaatgcctttaattttacttactgaaattctaaagaaataattaaggatgtgtgtaagatttagtggaaggttgatctttgcaagggctatttataataaagttgaaaacaacctgtgtccaataacaggagattggttaactaagttctggaacttagatacaatggaattctgagtagccactaaaaattatgttattgaagtatatttcgggtgtgggaaaaaagtcgtaataagttactgaattgagtcatgttataaaatagtatgtacttaatggaaacattttagaacaaaaatgtatatgctacacatttttaaacatctgtgagggtcttgctactcaaagtgtggtccccggaccagctgtttctgcatcattgggagcttgtcagaatcacagaactgcagcccagcacaacctcaggtgattcccatgcagagaggtcccaacgctgggttgcggcacccacacaaacatcacatctgtgtgtggggctactaggagtctattatttcccctttttgcttatttatttgtggcaactgtatgttactgacataataaagaaaaaagaaagatggacacactctgaaaaacacacagtgggcttcattgtcatggaagctttcctggctctttcctgtctgggacgccctcactgagttcactttaagtcccgctccttcttgggtgcatttgactctggtatggggggctcttggcttgaagagtggcactttcagaatcactgctgctttcaaaggggctctgctcctgccagacagggtggagactgaaggcccaagggccttcggtcccccagaccccacccagggcatgggccaggccccttgcttgccctcccactctgccgcatggtctgcccattaggatgcaggccgcttggcagattaggtcatttcttttccagtaagtgaattggctacttatgcattctcctgtagcaccaacaccagacacatttctcaatcctcctcccctggtaggacaaggccaggaacagactgtttccaccttccttacatcaatctgtcaggctgcggcaggtggctctgctggaaggccactgccctcgtccctggctgtccagaaaagtgtctttccccagttccagtgacgtcaggtggatgctgcacctgcagaggagagcagctgtctctgaagctggccctcgggtgacaaccccacaggcgatggtgagagcgaatgacgcttgtggctctcagagtgtggattacatgtggcaggccaaggtcttcgaagctctgaaataagcaagatcttctccccccaggcaaagcatagactaagccctgctctttcttccagttgagcaaggaggatccagaggctggggatgggttcccatctgacttggttctgaagcccatatcctgggagtagagttgccagcatggtgcctgaatatggtgtatggtttcccatgatcaagggtgaccaaagttttaaagacccaagaaagtgctgagtccagtggcctgatttcacttgctttattttttgctgagtactgaccttccgtcagggtttagggccaacttgtgtaggtagggtgtggggaggtccgcacctcgaggagcccagcatgggtgtggggggctcgtgctggctggttgcatccgtgcctgagctcagccttcttacacctttgcccatgaataccaccccctgcccccgcaccctcattttcagaaggtcccacccaggaaaggggaggtgccaccagctatggtttgggacaagctgggccctgcaaccagtgcttatagtggggagggggtggggagcgcaggggaaggcatgggtcacagtgtaccccatacctacccagccctctgcctccttcacctttgtcaccccactgtgtagttgtcacctgttcccaccgcgtctcccacatggcccctgtcagcctagggatcagcctgctatcagcacctgccgcctagtcctagccgcccactccaggggcctcctgctgcacttgcccttctcagagcagccactaccctgcagacctgaccagggtggagcatgtacagcctgcaccattgggaagacctggtgaggctcaagctgaattattctacatgctttcctgtgagttccaaaaatgtctgaaaaaactgaagaacacattgagagtcctcagccactcctctctcctccgtggatgcatttatttcactgtcttttctttccttcctgtctctgtttctcatggaggatgctgtgtcggccctcaatactgggggctcactgaccttcctccagcctcattcattcctcagatgagcagtcctgtctcagggctgaactcccctctccattaaattcctgcttctaaggagcccccagactggatcaggggctaccacattcacccacctctggcagcctgtacacatggatgcaataatcctggaagttcccaagaaggaaacccccactgtgtgttctcccaggcctcctggggtgcttcctagagcaggtgggaggagcaggaaaagtggcttcaccagcatctcttgatggctgttgatagaaatgttatgcagacgggtgggagtggggagggatacagagccaacgaggcccagcactctcctgagggctaatcttcggagtccctggcaggaggcagggagcaagtaatgaaggagcaacgcccagcaggagggagtcatcggactggagaccaagaaaggcccaaggaggcactcaaatgctgaaggaataaatggtgggctctggactttagttagcattccttacaatgtgttagacgagaaagggtctgggttcaaataggctaagaagtactgctcgcccccagttaaatgtgttcatctgttgcagagcctctcagagcctctctgttcattttcatcagaattgagaggaaaagttggcagtgagtaaagggagctgggaggcgacacgaggaaaggactttgtgggtcattgatccattgacccctctcctgtaaactctgcctgcatggccatcactcaaggacagctgaagggtggcctggaagggcctggaggaaaggtggtcattggggtggaacccaggacagtggctgtgaggatgtgggaggtgggtggccagtggtcaggacagggttctcccttggataaggcctgggccctgcgtggtcaccgtgatcagggcgggccagggcaccttgaagtaaggcaggacaaggaggcccggaggccatgagctgtgggagggacctgcgctcccccagggcttgcagagcactaggtgggcaaacctggccgaggcctcactgtggccctgtcctttggttctgggtatccctggcctttcccgggagggagaagcagcagcagattgtcctacctcggacatagcgggctccttccttccaggggcctgactgacctggcggcactcggggtagcctgctgggcgttgactcttgtcggctcctagccctggtctcctgggcaaacccctgcaccaaaagaagaaaggcccccaccagctccatcctaatctcgacccgcttgtctgcaagaggctaaaggagcctactcgactctcattctctgattttctgtcctcccctaaaacctcaggctcatccctggctccaagcccttcatcttctgctcttattgcctcccggcgcccgggattttgggctttctaacgccctccgcagcctgccaattctctatcacctaaggctgaagaactgcgtttgtgaagagggagtgcatggggccggggcggggctcccgtggagagggcggggcctcctgcggagggcgtggcctgagtgtagggtcgggggctgtgggcggggcggggcggggtctgagggccctgctgaggaaagccggtgcctcctgctccccagccctgtgctcccgcgcccccagtctcagcgggttccggcttagtccggcaccctgggggaatgctgcgctctggctggcagcacgccctgcctgcgctcgccccgtctttgctcctggtcaccatgcgtcctgcacagttaccatccgtgcccacatgctgccccggggtcgccgtgtccagatgtggctgggtcttggtgtccccgctgcgctcgtccctcctgccaccaccgtttgcatatgggcctttccattaagaatcacgcgctccgggcagggccagcgcgctgcgggcagctccctaagaccccgacgggcgtaagcctctctgcctctctgtccagtctggcctgggacagacacctgtggacacctgaggcaaagggaagtcggggcccagggacatctcaggggaatagggtctcgggaaaaagggagaggctgggctacgaaggggagctggggtaggcaggggagcacagccctgcaggagggcaggatgcccgcccggggcggaagagccgagggcaggccctggggcggggcgctgggctatggagaccacgctcctccgcccagtcctgtctgtccgaagcgacgcggcagggcacaggcgtccgcagaacccgccaagcgcgggacgggcctctgctcctggctccgccggccttcccaggccccgggagccaggaaggtctgaatggagtgatgcgcctggacttttgttcggaaatcccgcgtggagggcggcctagcggggagaggctggaaacaggcgaggaggagcagggccgcggttgtacgggacaacgggaaccgggtcttccctcgctaagaaagggaagggtctcagccttactgagaggagcccctgtggaggaagcgggcctgcacctgcggcttccctgcaccccgcacgccgtgcccaggcacttcctccccaacacaagcaaaggtagcccagctgcagccggatcctccctgagcgcagcgcaggggtcacagcccccgacagctgcgcaagtctattcctcccccggccttttcagcggccgtccagagctcagcatcagcgctcctggcacagaccccactgctgactccattcactcccctacccccccttaagctatttgaacttctcacgccctccacctgcagggccgggttatgtcaccggctgacgtcaacagctgtagaggaataggagcaggtttccgttttcctctcccggcacctggccaaatgcccagatatgcacccactccctactgctgcctccttatggctgcccaccagccccactgagatcgaatggggagcctgtaaatcctgatgtcacccagtctcggggccgggagaagctctgagccaggcccccaaacctggcagggtccagggctgggggcaggtcaggggcctagcctgttctcctgctgcctgccatggctggctccaaggagggtggaggccacactccacacacttctgtcacccagcaggctctctggcctcagctcccactgggcttggacagtgggagcaccagcagggttcagagccacctggaagcagctcactctccaggtcccaccccatctgggagcagctctctccccaggtacccccgcggcagccgtgggggtggccttctctaccaaagcctgctccttgctcctgccagggccgtctctaaggcgacagccacacctgctgttgtcccatcaggcctcaaagaggtcacgtttccctgtcctttccagtctcctaagccccacttacgcctctaaacagactctaccgatgccccaggtcagtgttggggtcctggctggtgcagctggtgggtgtttgctctccttgaattcattctagtctttgacaagcatgcattgagcacctgttgtgtacactaggcctgtttaggtgccaggacaggaggagtatgacttgggtcctggcctgtgagaggccagggcaaaagcagtggggaggaggaagtggtggggagatttagggccccatgtgatccccagtaccccaattcatgtcccaaaacgaaaaaaaatggtaactcttggccatgttgtgcaatagtccctaatcagcaatgtcagctgaggacacgtccggtccacattatatttaatgatggtctagcactgtcattacccattttttaacaagatggccaagaaagccacccttgagggcaccagattgtcttcctgctgtttctgtcatgctctgcttctgcacacaggagacacactcacaggcaacatgcagacacacatacatgggagacacacagacacacacacacacacacacacacacagaggagcgaagcaggaactagaggctggccagctctacctcttctccaccaacatgttttgagtcccctcggacaaatcaggccccataaggtatggggtctccctccctggtggaggtcacctaggtggttcagtcaaagcccccagtggtggacaggccgagagcaaagaggcttctcttggtccctgtcactcctccctcctacactctcctttcccccttggccccaaagaccaaaccatctcttggactcagaggcctgtgaggtctcctgggggtctccaggcctggatgcacccagctgcttctcctgggcaccgaggctcccggcacgccccctgtgactgggctctcatctcatcttcacctccgtgtcgttcagcttgccctccacccatgctggtcctactggccatggaaagccgctgctgcaagacatccttcagtgactgtcctggctttgtgtccatgcccagacttagggggaaggggagaagcaccaagtcttcagcacagagtcagtgaggggagaggaggtgcttccagtggttggaaacgttcgatttctttttaagagtaagttttagctgataaattccactcccgtcgatatctttttccagagaacacctacggagataaggaggtgtgccccaccctgaggggctcggggagagagaacaagcaggaggctcagcttccccatctttgtgtcaacagccccttcagctctgccatcctttgtctaaactcactctcccgcactagagcacactgtcctagggggtgctgtgtctgctccccctacctaggtcccctgcaccccaccccacacccccacctgctgaatgaatgaattcagcaagtgaatgaacaagtaaatacccaatatttccttgcacaccttgcactttgcagaaaagagttgggtgggggcagttttaattcttctgtgctctctctttccatctataaatccctacccttgaccacctgggccatcctcacacagcccagggacacacacagggctggctgtcattcttgatacccttcccattgtatccttcctgtccagtggaccccctcaaaagacaggaaaatgactgtgaccactatgtaaatagggagagatgccttcaggagtcactgctgccttcaggagagaccagcacccatggaaaggagccctaaggtctctacgggtgtctgttttcatttggacaagtagcttgatgaatgcggacatgcagtggtaggttggaagtagaggcaagagcggggctgaaaagagtggacctgtctggaaagaagtatgggaacatcgggcatctcttggaacactgcaggaaggtgcaggaaggaacagcacagagcggcagcctcagcaggagcaggaggccactgtccactgagcaccttcaggtgtttgccaaagtgcaacatgcacccttccccgaaggctgcctcacactcggccttggagctccacggtgggatttggggaacacagagacgtccacagtgaaacgactccatgaactcagctggcagcaataggagcttcagatcacaggtgaccaggagaatacgtgcccctcaaggactatacaaacctgggggaggtgctgggttttccacaattccacccgacctgtaccctgggacacctgggagaccatagggaagtgggtgctagtgaggctactgttgctgccccccaggcccgtggtgagggcagggtgcaccatcacagccgttggccccattggcagagcacactcatatcaccccctgctgcttacaccagccttgtctgtactcaggaatagggacagcaatcgttcccattttatagatggaaatctgtgtcctgcggagaggacataattgactgtacctagtaagtggtgctattagggctgttactcggacccctgtcctgagcctggacttcctcctgccaggcttggagaaccccatcagcccacccctgcaggaaccaccagctccacactggcttcctaacccacaagcatcgccaaatgtccatccccccgccccggaaaacattcagttgcatctctatcttatacccttcacaaaatacattttgggtggactaattctcacatgcaacatccacagttgcctttatctaagtcttagagtcaaaaacaagaggataagtttataaacttaggttaagaatcttcttaattagcacacaaaaatcaataaatgaaaatagtgataaacttgacttcaccaaaatgaaaattttccgtatgataaaagattccacaaacaagcttgaagtctttctaccaaatggagaaataatttgccatgcgtacaagtggccagaaaatacaaacaagtcctaccaaccagtaggaaaagactaacaatgcagcgtgaggcacaggccaagaagaacaagggcaagcgcaaacacaaggtgggaggtgggcaagctcaccacggccatggccatggccactgagggatcctgagccacgcccaggtcagcactaagtttccatcagctggcaaatgttttgagttcataacacctgggaagggtgcaggagtggggagcaggtgttttcttcattgccagggattgtaaaggggtggagctgccctggggcttccaggcagtgcttactgatgtgccactcatgcacccaggagctggcacttccatcctcagactcccccaaggctcccccagtatacatgagagcaggtacacagatgcccagcagcactgcctgggaccctgcgtgaaaactgaaaggtctagaagcaaatgaaaataccatttgtaagaaaatggtaaaaggaaactatgtgcctatgtttgcgcacgtgcatgtgtgcgtttgtgtgtgtgcatccatgtgtgtacgcccatgccatggaatacaatgctgcaatgaggtggacaacgtctacaatgaggtagacaacgtctacaatgaggtagacacaggatgatctccaaggtcagtgaaaatgttccgtgcacaccagacccactgctcttggaatcaagataaacccactccctgccttccaggccctccctggcccctccttcactgcctgcccttgcccccagcccagctcctgggccctctgctctcctatggcctttctctgacctctcatccacctcaaggctgccacgcatccttcactctgttctccccactggagccggccctgaggccgcttcccaaagcagcctttgctaaccactgcccctcaatgtgcaccatgctcctcgctgaggtgagacaggtgcccaggggccctgtctgatcacatgctgctcgcacagcatgctctcctagctggcacctgggaggtggtgaacctgcatgaacatcagctagacggctaagtggtggcacatagattcggtgtcgtgtaaatgagaggcacagaaagcggtgctctgggctgggggcagggggtggctcacgcctgtaatctcagcactttgggaggccgaggcagtcagatcacaaagtcaagagatcaagtccatcttggtcaacatggtgaaacccactaaaaatacaaaaattagctgggcatggtggcacgtgcctgtaatcccagccactcgggaggctgaggcaggagaatcgcttgaatctgggaggcggaggttgcagtgagccgagatcgcgctactgcactccagcctggtgacagagtgagactcctcaaaaaaagaaaatgaaagaaaaagaaagcagcactctgtgtttctgtgggcacgacctgtgggctcatgcgctcaggaggctctagaggcactgacactcatctccgcccatgcctcctctggcctcatggacggtggcaaagtggaaacaattttaatcaaggtctgtatttttaacaaaaaatgtattaatgacttcggattcttaggacttgtgatttttcacctttacactggtgtgaccgcaatatgcactcggtagaacacgaacttcagatttggtgatatgcaatacaatgatcccttcagatgctgggcagtggcgtgagcacagctctcggccaacatatgactgcaggccaaacagctgctactccaggacgctgtggcgctggctgattctgcccaactgtaggtgaaagtgagtgctccaagcgcgcttaagcgggctgggctcagctgtgatgcttgctagattgggtggattaaatgcactctcaactcaccttattttcaacatatgatgagtttatcaggatgtaaccccctcaaagttgaggagcacctgtacagtaaatgaaaatataatgaggaaaagattctcctgctcagtcgctgtttactgaggtatgatctggggcgggaaactgggcttcagccctccaccacggccacccagagggccctccttgagcatagagaggggcttctcatcgggaaaggcaggggagacttcccgggtgacgctgagcagaaaccaataggcaggcaagacacaggcaggggtggcacgggaaggagagaggtggtcccagccgagggggagcgcaggaaaaccccagagatggaggaaaccaacgtgccctgcctcctgccctggatggagaggcccaggccctgaccaccaaggcaacaaaggcctggcccagcgcgtgcggccagaacttccacccctgtgcatctgtgagggatggaatctggagcaggacctttacaggaacccctgttcctctcaggaagggacttggggcttcctaggttgtctacaatccccagagcatccctttctcatgactgccatggccccacttggcacaggcctcagcctccttcccggtgctctgcggcctttcagccccttctccccttctgggccccctccagacttcagtgggtctggagacaataagaatttcctaattccaggctgcgggtgatggatgcagcccaccaggcccctgccacggggtcttcaggaagccatctcccttctccttggactctgtaattaaagctggggataacctactgtatttcctaattagcagccttaatccctcatgcacaccattaacaggctggcgcatctttagatgtgattggtaatgtcgttagcctaatccataatcaatacttggataattgcttccttgggtttatatttagtccttggggtcttgggctggggggaacatccatctgcagatgcactaatggctgtgtggaggtcgcccacggaccgctcacccaggacccccaggagctgtggcctgtggtcagagcaggtgctgccacagcaccggagacccaggccctggtgcatccagggatctctgcaggctgcggttgcgaagcctcctggtccatcaaggccttgggctctggttccagaacactaggggttatttcagaaacaaggtcaggagaccccagacctcagacctcagaccatggcagtgtccgcacgtccccaccccacacatccccaccctttcagaagagtctgcggggggtacagaggatggtcccagactagagctgcaggactgtcacagcctgcacattcctgctccacgcgggccccagcgcccctcagctccaggcacagcccctgtcctcgcctcccccgcttgccaggaaaccgtggcccagcccgacgtgatttcctttctctcaaaggctggcggcagctttggcagctcaaggacaggccagggcagaagaagagcagcctgtcgaaggcagcccttatgaatgggatctcatctgactgtaactggaattcgtatggaggctccgcttacaggaacttccccagcagacgaatctgggccacagagttctgagctggaatgccccaggagccagccataaatctccccaaaatgagggtgcacaatctcattgctctggaggtgcgctgcttgcccctggagacgacttgtcattctgcgtcctccaggctctgcagagagccaggagccgggccagggagaggtggatgggagttggcaaagtcaccgtgaaggtaaacatttttatcatttaattaggagcctctcagaaaagcaagctctgtttcgtctagagctggtcaaaggaaatgagaagtgacattttcccacccccacgttccccttggcccgggaaactccaagctggaggcgcgggatgtgggcagcctcaggctgtgcacatccagggctgggcccaggggcagtggtggggcgtgcagcctttgctgtgctctggccgtgcccggcactctcgctccctcatttgctctcataaacgccgtctgcattatcgatcaccctctgggtccctccataatgcaggggcttcaaaccgcacccgctccttgagggtgctgcattcctgtactctctgcatctcccaagcatatgtgtgacagcaagatggctgcagatatgcaacttccaataatcaatcaactcttaaatgatcctcaataaacccttaagtaatgaccaggagcccctcaccagcatatctgtacccatttgttgctccatccatcccaatgcatgactgacaagtgttcacacacgtgtcacccgcaggctccactccagctttggaggatgcaggcaggacgtcactctggggctcctgtctcctggggagatgacagtgagggagggacactcatgaagaacctccctagccagttcctgactctgcgactgcccagactctgagggtactgaccaacagagctcactcagctacacagagatgaacctggaggcctagaagaggccggcctggcctgggtgcaaaggccccaggcagaagagcccagatgtcctcacttctttcccagtatggggcacccaaaacatgcagctccattttaatgagcagctgctgtcctttttcagctgctatgggcccactctgtccaggctgcagcctctgggcagcctgaatccagccaccaggtgaggcacatgcatggagaactgtaagaacattgagacttcgtgcctcactttacagggcagcaaatggaggccagagagggcaagatacatggccagggatgcacaggagcaggatgaggaaccgggccttgctcccaccctgcactcggaggcccaggtccacctactacagacaaggagtccgtgggccaggggtgggactcatctgtgcacggagggcccaggctgttttttctcaggagggacaaggctctagtcaacactgcatcagggagggacagatgtcatctattcagcagggggttttagcagcttccttagttcttgggcttcactgggtccttctgccaacaagcatggcccctggccccgtgtggacactctcccagggcagaggccatggctaaccagcctgagctgctccagatagcccagcagagatatccaagcagctggagccagccagccctcagcacatgtccatttattcttgcagcagctacttactgggcctgggcggagacaagatgatccattctggatgcatatatatgaagaatataaagcagggctggtgggatggggacatcatgcaaatgtagtggggtgctggagaagtctgtctgccaaggtagccaacaaggagaagccagatgtgctgacagctgtctagggcggagagcagcagagcaaaggccctgtggcaggaatggatttgctgtgttccaggcaggagaaaggccagcatgatggagccaagtgagccagcaaagtgaaaaggccagagaagcctgcagcctggggcatgggttccattcccagtgcaggaaactgggatttgaagcaagggttggcatggttgatactttcagaagagtcagtctgagaggggccctggatgccaggctgaggaggtgggacttccttctggaggagaaaggaggaccaaagaggcttttcagcagggagctggcaggtcactctccagctgtgggagccagccccttctccgggagctgtgcgggtgctgggcgccatcaagacagctccgctcctcccagccgtgagacttgggacagagtcaccctctcaaattctgttttgttctctgcaaaatagacataaaattttagacaataaccagctactccagccaaacaccatataaaaaatggtggcttgttcccactcacaccatcaaaggccgagtggggagcctggacttccaccctggccaggctgtaatgagttgcccaatctccctgtctccctgatgagtggtatcagagagggctcagtgaggggccaggaccttcatccccaccaggcagtaaccagccccttccaccccgtggtgtcagtggaggctgcacagggagcaggagccttcgggggaacctggactcctactcccaccttccacactgtgcctgccagagtggtgtcagaagccgccagctaaaccagaaggtttcaactcacattcagaatttcataacatactgcacaaataacacaatacaggagctcagcagcagcatggggggacaaaggaacacatccatgaactccaagagaaactatagaaattatttaatctgaacaacaaagctacaatagattgaaaatgaaaacaaaaagaacaatccctcaggaacctgtgagactgtaacaaaacatctaattcatgttattgagtctcagaaggagaggagaaagaggtgggccttaaaaaggactcaaagatacaatggttgaaactccctaaatctggcaaaagacacacacttacgaattcaagaagctgagttactcaaataggataaaccaaaaaaatccacaccacgacacatcacggttaaactcctgaaaaataaaaacaaagaaaaaatcttaaaagtagttgggagagaaaagaccccttcctacctatagggaaaaaaaataagaacgacgacagatttctcattagaaagcacagaggtcaaaagtggcacatttttcaagtgctgaaagaaaataactatcaactcagaattctatttccagtaaaatattcttcaggaacaaaggaaattaagatattctcaaatgaaagaaaagtaacagaatttgacaatagctgacctaccctagaatgattaaaggaagttctctaaacagaaagaaaatattaaaaataaggaatcttgaagcatcagaaaggaagagaaaaacagtaggagtaaaaaatattggtaaacatttccttctcatttttggttttctaaattatatttgaccgttttcacaaaaattatattgtctgatgtatttctgaatgcatgtcgagaaaatatttaagacaattgtattacaaatataggagggtaaagtagcttgaaggggcatgagttttctgtactctacttaaactggtaaaatattaacatcagtacactaaattatgtatatataatgtaatacatcaaatagccgttttaaaagctatacaaaaagacacactcaaaacacactataggctgggcatggtggctcatacctgtaatcccagccctttgggaggccgaggtgggcggatcacgaggtcaggagatcgagaccatcctggctaacatggtgaaaccctgtctctactaaaaatagaaaaaaaattagctgggcgtggtgtcgggcacctgtagtcccagctactcgggagactgaggcaggagaatagcgtgaacctgggaggcagagcttgcagtgagcggagatcgcaccactgcactccagcctgggtgacagagtgagaaaaataaaaaaaaaaacactatagacaaatcaagctggaattctaaaaaactttaaataacccataggaaagggaaaaaagctcagatatactaaaaatagtgagaacaaacagaaaaccaaaacaaaacataaaatggacaacttaagccctaacatgtcaataattatgtgaaaatgcaaatggtctaaatataccaattaaaagacagagatggacagaatacactaaaaatatgacccacctatatgctgtctataagaaactcacttcaaatataatgatatgtgtaggctggaagtaaaatgacgggaaaagataccttacacaaacatcaatcaaaaaaaagaaagcaggaataagtatattaataccagataaagtatattttagagcaaagaaaattgctggagacagaaagggtcattatataaggatgaatgggtcacccaccaagaagtcatagcaattctaaacatgtatgtacctaacaaaagagccaaaaaatatgtgaagcaaaatctgatcaaactaaaatgagaaatatataaatctacacttctttcaacaattcatagaactactattccaacatagaactactttcaataattcacagaactactaacagaaaattagtaaggatatagaactcagcaacaccatcaaagaacgttatctattcaacagatggagaaaactccatgcagcaaaagaagaatacatattcttttcttttcttttcttttcttttttttttttttttgagatagagacttgctgtgtcgctcaggctggagtgcagtggcatgatcttggctcactgcaagctctgcctcccgggttcatgccattctcctgcctcagcctccccagcagctgggactacaggcgcacaccgccacatctggctaatttttttgtatttttagtagagatggggtttcactgtgttagccaggatggtctccatctcctgacttcgtgatctgcccacttcggcctcccaaagtgctgggattacaggcgtgagccactgtgcctggccaaatacacattcttttcaaatgcccgtggaacatattccaaaatagactgtatgtaggccttaaaataaacctcaaaatttttaaaacaattgaaattttgtagagcatgttctctgactgtaatggaattcaactagaaaccaacagtggaaggataataagaaaatctctaaacaattgaaaacaaaacaacacatttctaaataatccatgactcataggaaatctcaagggatatataaacaacgttagactaaatgaaaagaaaaatgaaaatgcaatataccaaaattagtaggatacagctaaaatagtgctgagaagatggtggatagcactaaatgcctacatcacagaagagggaacatcttaagtcattaatctatttttacacctcaaaaatctagaaaagaagagcaaaataaacccaaagcaagcaggagggaataataaaaataaaggcagaatgaaatttatgaaattttaaacagagaaactatagataaaataaatgaaacaaaaaagcagattcttttaaaagatcaataaaattgataaacctttagcaagactgacaaagaaaaaagagaaaacacaaatcattaatatcgtgaatgaaacaggatatgactgcagaccctgaagactgaaggaaatcaagagaatactatgaacaactctgcacacataaatttgacaacttacataaaatggatgagtccctccaaaaccaactacaattcactgaatgtgaaataaatagcctatagccattagtaaaattgaattcataatttaaaacctcctcaaaaagaaatcttcaggtcgagatagtatcactggaaaattgtaccaaatgtttaaagaagaattaacaccaattctacacagtcttttccagaaaatagaacaggagcaaatgcttcccaatactattggtagtattaccctgacacaaaactaattctgtcttagtctgtaaccgactaagaaataaaaggaattcagactgggaaggaagtaatagctgcccctgtttgctaatgacatgattcatctgtaacagactaagagagtgttaaaaaagaaaaccataggccaatattcctcataaatatagatataaatattcctaacaaaatattggcaaataaaactcagcaatatataaaaataattatatgccatgatcaagtagggtttattccagggatgcaaaagcagttccaatatgtgaaaatcaataagtgtaatccacttgataaacaggctaaagaagaaaaatcacataatcatattaattgaggaagaaaatgtatttgacaaaattcagcacccttgagggatgggggtatggggaatgactggctgtttaacagtctgggcttccctctggggtggtaaaaatattctggagctagacagcggtgatagttgcacaacattgtaaatgtcctaaatgttactgaatgtacagtttatactgcttagaatggtaaattttaagttacgtgtattttatgaaaacaaaaaattaaattcaatacctattcataaagaaactcagaaaaataagaactgaggggaatgtcctcaactcaataaagaacattgacaaaaacctaacatttaacattatacctactggtgaaagactggataatttcctcaaagatcaggagaaaggcaagggtgcttctcttgccacttctgttcagcagcatcctagactttctagacagtgcaataaagcaagaaaaagaaataaaaggcattcaggctggggaggaagaaataaaacttcccctgtttgctaatgacatgattgtctatataggaaattctaagaaatttaccaaaaaaaaaaaaaaaagccaaaaaagcaaaaaaccaaaaccaaaacaaaaccatcactaataaataagttcagcaaagtcttgggatatgaggtaaacatacaaagaaaccggtgaatttctatacactagcatgaacacagggacactggaattaaaaattacagtaactaaaattgatgaaatacttaggtataattctaacaaaacatgttcaagacttatatgccaaaaactacaaaatgctgatgaaacaaatttagagaaattttttaaaaatctagataaatggagagacttactgtgttcatggattggaagtctcaacataggaagatatcaactctctctaagttggttttcaggtttaacacaatttctatcaaaatctcagcaagattttttgaagatatagacgtcattctaaaatttacatggaaatgcaaaggaactggaatagctaaaacaattttgaaaaaggataaagtgggaggaatcaatctatgtgattttaatatattatttagctacatttatcaagactgtgtagcattggtggagagttagttacatagattaatggaacagagtagagaacccagaaataaacccacagcaataggtccagctgattttagacaaaggtgcaaaaataattcaatggagcaaagatgatgctggagaaatcagacagttgtaggccaaaaccaaccaaacagaaacctgaaccttcacctaaatctcacatctgattttttaaaattaacttaaaaaggataatggatttaaacataaaatgtaaaactataaaacttttagcaaaaaataatagaaacttttcaggatttagaactaggcagtgttcttagatttgatgccagaagcaaaatccataaaaagaaaaattgataagttggattcatcagaatgaaaaccttttgctctgcaaaagatcctattaagaggatgaaaagacaatctacagactgggagaaaatatttgcaaaccacatatctgacaaagaaatagtctaaaatatgcaaagaattctcagaacaaaacaacaaaaaatccaattagcaaacaggcagacgtaaagcgatcttttaccaaagaaatggcaaataagcacataaaactgactgtcagcaatgtgtaaactaaaaccactacacccttatcagaatggctaaaataaaaataaaaaaatagtgacaccagcaaatgctggcaaggatacagagaaactggatcattcatgcattgctggtaagaatgtaaaatgataaaggcactccagaaaacagtttgtcagtttctttaaaaactaagtatgccactaccatatgacccagtaactgcattcctggcaatttatatcagagaaatgaagacttatgcttactcaaaaatctgtacataaaagttcacagcagcttttttagatagtagttgaaaactgggaacaccccagatgtcctttattgggtgaatggtttaaacacactatggtacatccataccatggaatactgctcagtggaaaaaaggaccaaactcttgttacacgcatcaacctgggtgagcctgcagagaatcatgctctgtgaaatcgccagtgccaaattgttacacactgtatgattccatttatataacattcttgaaatgacaacattacattaaaatggtgcaaaagtaactaaggtttaatagaaatgcagactaggttagcttaatggctcccaggggttaagggcaggatggggttaggggcagggaattcctctccttgagggagctgggagggaagtgggtgtggctataaaagagaaacgtgagggatcctggtggggaggggatgttctgtctctccacagtatcaatgtcagcatcctgattgtgacattgtagtatagtttgtgtgtgtgtgtgtgtgtgtgtgtgtgtgtgtgtgtggttttttttttttaaaatggactctcacacttgttgcccaggctggagtgcagtggcacgatctcggctcaccacaacctccgcctctcaggttcaagcgattctcctgcctcagcctcccgagtagctgggattacaggcgcgcgccaccatgctcagctaattttgtatttttagtagaaagagcgtttctccgtgttggtcaggctggtctcaaactccctacctcaggtgatccacccgccttgacctcccaaagtgctgggattacaggcatgagccaccatgcctggccaacactgtagtatagttttataagatgttacctctggaggaaattaggtaaaaagtacacaagatctctctgttttatttcgtagaaccgtatgtgaatttacaattattcaaaataaaaagtttaattaaataaaaaaatcactaaaaaaagttgcctagaagatttaacaaaattaaaccaatctgtgaatttaatgacataaagcatccaactttattgcttaattgttaaacttcatccaagcaatatgtagacattgcctaaaatatttcaacatattacaaggtttataaagaaaagtggcagtcccctgccctaatccccatccctagaagcattccatgtgagtctgttggctgttccttctcacgtttacttttatgattctaagtaaaatgcttaggctgccggttcttggtttttccattttagtgttaaccgaatgatggacttcttcccagggtaaataacagtcctgttcccttacacatcccctccaaccgcccccaccccacacacacatccttccctctccacttccttccaatggagttagatcatgatattgggtcaaattaatgttttatttttaacacttggctaagtaaatacccttcacagctgagtccgaccgttttctagccatccgtatcgtatattcatgcaataaatggttattggcacccaatgtttgccgggcactgttgcaggtgctggggacacagcactggaaaagcaaacagggtcctgtcctggagaagcttccatttttgaggattgggagaccaataagaaacaagttcaggcatattttttccggagataagcaccaaggaggagccccggacggggtgccatgagcaggggtgccctagggaggcctgaggagaagaccctgccaggggctgaggggagaagaggggacttgcgggctcctagaggaagagctcatccaagcaggacggcagaagcccaaagtcctgggagtgagctcgctgtcccgaggcccaggtgaaggggctgatatggttggggggagtccagctgagtcccttcttgccacccggggccccactgccacggggcgtcactcgcttctcttattaatgccgtcaccaccccttggcttcagctaagtttcagctttttccactctgaagccagcacctctcatctgttccgttctacccgcagcgttgccctcgtcctccccccaccctccgcctcatgggcgcaaacactcgggagcacacgtggagggtggaggcggcacagagacctccccagggaaatgaggctccagctggatttgaacacgcggggaggaggtgaggatgctgctttcccaacagctgggccgcctcgtccttgtcaccgctctggtttctcagcccaggctattttgggtcaggctgcgaggaccgctgcgtcagcgagtgggcgtgagtggcggcgcctacctcccccagttgggccgggcacagtgccaggccaggcccacccaggctgcgccaggggccgccagcctctgggcggcagggggacccctggaaccagggagagtggcctgagcaggaaatcaggtcccaggtaacacgggcttcagcgggctcaggctggggaggggacaggtgtctcggactgcgggcggaggaaccgcgcacatcagagggcagcgtctcagggcgggctgggatctggggagggattcgccaggaggggtcagtggcccaggccttccaggctgagtggcgctgggcagaggcacgaccaaaggcaggaggctctgggactatttagggaggagggaggctcaccgaggacacagaggccaggctgggaggtggccaccagccaggggcggggcagcaggtcagggagatcggatttccccagctcccactggcccgcgccttgcaagccggagatttcccctgctccgtggaaccctaacagctactctggggccttgcgccccatcccaggaggcccaccccctctcccggccagttctaccttctctgtctcagcaacccccacccttgcgactgaatgaagcactctgaacagagaccttttgaaaaaagtctaaatgtccccttcttaggtgagggaagcaaaagggaaaaatagaatcgacaccaatgacctattccagtctcccctcccgactgcagaaaccagcagagccacatgggcccacaggcggggcaggcccagctgcaggcaccaccctcctccctgtcctgagccgggcttgctctcagagcctgctgctgtccccaggctagggatgcgcctcccagcgggaacccctgtggagggaaagccccgcccagcccgaagctcagtcgcgaggaactgccgtctgttgagcactgccaggtactttttgactcatgggtcgttttgctctaacatgtgtatcccttaaaactcagaagagagtctggtcttgtttactcgcggttttttttgtttttgttgttgttgcttgtttgtttttcttttgaacaaggaggaagaatatctataggcaggaagtccccaactgtcctagtccccaggctgctattaaaaagtaccatagactggggacttaaacaacaaacacgtctaacagttctgaaagctggagggccaggcaaggcgctggcagatccactgtgcggtgaggcctctccttctggctcatccctggtgccttctcctgtgtcctcacgtggtgggcaaagcagctctctgaggtccttgtgtaggggcaccaatcccattcaccagggcaccgcccctgtggcctcatcacctcccaaatgtcccatgtcttaatgccatcaccatgtgggggagggcttcaacctgtggatttcagatacacactaggcccacagcacacactcaggctgaggcctgctctaccatttccgcagacccctctggacccgtcgcggtgctagtctgcagctctgttcagcacctgctgtgctcggccaggctgagggcagtgggtgggcgaatactcctgttccctcccctaaagctcaagcaccccttccagcaaggttctgctgtccctctgtcacaatcaagggaaaacgaggtactgagggtcccatggcacggccccgcagccaatcaccaggactaggcctgggagtcagcccccagctgtcatgcctggaaaccctgacctcacttactgccaggcccagggagggctgtcacttccctgggaagggccctccatgctggggacatactgagagtgccgactgattcaaaagactggaggagggatccaaggcaggaggcctcctgagggcctgaatggccacagactgtaggcacagggatggagagaggatgctgtgtgtgggcaggtcagcgaggaaggttggtgggacccatgggcctaagggtgaggaagagtcaaagatgacttgaggctttccaggggcacaaaatagaggatggtgaggccatcagggatggggcaagctgtagagggtgccgtgaggggctctggtggcggagacttgagctttctgagtctaatgaaagaaagagaaattggagagaagggccccaaggggtactgacctgggccgggctccagcatccagttcctataggggctatgaaggcctgagattagggtccgtctcaatttcagggggatttctctgctgtggccaaagcagcctgaagctaggccaggagttttgtctcctcactgccttttctggagtgccttgtagggattaatgcaggagggaaacccggttgatttcaggtgtgcaggggtcttgggggagaattctgggtgaggagcctacaccatttgtcccaggtgcagcttcgcccaacacgcacaggctcagcagggctggtcaggaacgatcttgaactgtcagcaccctcaatgagcctttgtatgaactggaaacagacggtgacactgaatcagggtacaccggggtccaggactgggggtggtccctggagggatcacagcccccctctcacagggcatgacccccatacctgcgtgctgtgcccctgaacctttgggtcccatggggttaccaagcaagcactggctcccagccttgtgacttcaacatggccaggagcactgtgcaggtggcctcagagaaaaggggcgggagggcccagacttttgctgggcaccccacctcccaggagagggcacctttctttttctgtgggaggatctgcagctgtggggcagacccccagccctcactagactgctcgggtttcctggaggctccgggccaagctagcctgagtgcggaaggtggcaggtgccccagatgcagtgtgctccatgctctcggtggctgtggccttcctgcgtgtgtccccatcggtggagtggcattggcacgctcctcacctgctcgcccacaccattccagccctgatgattaattgtataattagctagaagccacatgttgctcaggttgaatttggtctaaaaatattttcttatgaaaaacacagcagaacctaaaaatatctcctccacagttgcccagggaagcctcctgcttgggccacccccagccatccctagctgcaactcagtttcttggagagtctggaatgcagaggcagagggctggccaggcactgcttcccaccagggcaaggtgagctggggtatcaagactgtccctggcattgccagttcccacaggctcccaatgcctacagtaggtcagaggctgctggggctgcctgggaggctcctgtgtgcatacaggatgcatgccagcctgacttcacgggggctggggcagtgccacagaggaggcacagacctcgtggggtgaggtcctggaaagggcttcctcaccctggtgagccatcagggaaggcctgcaaaggaccagtgctgagctgggtgggaccctgcacaggcagaactccctgctgacctgtgcaggggagtaagggatgctggaagaagacactggccctgccctagagcccctaaactgagcattgctgcggctgaggcccgtgcacctggtcccatccctgcatagggcttggctgactggctacatgtcctgtggctggtggggacagacatgagcagggacatggagcacctgtatcttccaggctttagcacacagaagcaaccaccctgctctggcacacagttctccctgggtgggttagtcacaggggtcaagaacttaccatcttgcccttctcctcttcccttttggtgtccttaaatgggggccaccatctcctgcttcggaggctctgccttggtctcaggagaggaccccgtccacctggcctgtctgtgcaccttctatcccatctctggggtagatgatgaacccttagtgcctccactccctcctggcccagtggagccctggagcacatttccgggcccttctctctggtcccaggtgggtggctcaggcccagagagcttggcccctctggatggacacagaaaggtgggggcacagccaggatgggcactgccttctcctaagcaagcccaggtgcatggatggagcaagtgggggctccctgcagccccatccagccctgagtctcaggcccagggtggtgtggcagggatttggactgagtgtggcttgcagagggcacacctgcctggggacaaaatctgttaaccccaggtttaaacaataaaggcactaacaatctaacctccagagaatgaggaggtgggcggctccaggtgcctgttgcagttaaaccccatgaagcctggctcctgtctctacagtcccctcaccttccttcatgcttcaaagatggctgctgcagccccaagcatcacacgtatcacaaagggaagagatggcaccagcaaaatatcttcttcctcctccctcgtttttcagaaagccaaagccctcttgccaatagcttctccttgtcttgactgaactgtgcccacggtggtcacatggccactactaactgctagagtgtccagtgaagccagtgcctgacaagggagagcccagctgctataactggactggaacaaacagaattgcagcctctgaagctgagcacattgcaaccccaaactaaagcaggtgctgaaggcaagaagaggttgggagaatgttttccacaggagaaaacttcatccttgtgatctggggaggggcaaagtctgcgaggagaggctctgccttccccccaaccaggggcccacatttccatctctgataaataattggtaggtgtcgttccctggagcagatctgtaactcactgaggggaccttccaagctggttctgtgttaaatacacaaatcttaccacagcctttctgacaatcaggcatccaggccctgctagatccctgttgaaaggaaactcatcacatgtcaggcagcccattccttctggaggcttctctgacaggaaccacatccttattttgagctaaaatgggcttcccttggcttctagtcattaaccctagtcctactttcccacattttttttcagcaactttctgtgaatctattatttcaaaacacaaaattaaaaataagttaaggagagacacaaaaagtctaagaagtgcctgaattgtacttctagagatgaacattacaatgtctgagataaatagtacactcgatggcatgagcggcagattagacattacaaagtagcttagtggactagagacattgccataaagactacccaaaatgagccacacaaaaaattaggaatacaaatgaatgtaaagggcatcagcaaactagggagaaatccgcaagtagcctaatatatgttggaattgtagtgaccaaagaagtgtgggaacagaaaaaaaatatttgaagaaatagtggttgaagagtgtccaaactggatgaacactttaaactctagtgcaagcatagccaaccacaagcgcaagaacaagaagcaaggagaaaactaaccaaggtgcaatcatgatcaaattgcttaaaaccagtaacaaagaaaacatcatcaaagcagccgggaaaacaaggacacgtttcatcaagaggaccaaagagcatgaagataagagatttttcaccagaaacaatgcaggcaagaagtcagtggagagacatcattaaagcactgtctgtacaaaactgtcattggaggattgcatacccagcaaaaatgcctttcaaacatgaaggtgaagttgaggcttcttcagacatacagaagctgaaatcatcagcagatcttgtctgcaagaaatgttaaaagaagtccatcaggcaaagtgatactggatgaagatctgcacttacaaacaggaatgaaaatcactacaggtgagaactacacaggtacatttattatttaggtctctttaaaagaaaattgattctttcaaaaaataatatatagtggggtctgtgataggtaaaagtgaagcgtgacaccaatagcattgacaacaatagaataagggtggggagaagtatctcactataaaaatctcagactatgctaaagtcctgtgatgccaagatcgcttgaagggattgtgatcagttaaagactcacactataaagcttaaagcaaacactaaaataacaaacaaagagttatagctaacgagtcaaaaaaaaagagagctaaaatgtaatcacgaatacttgattaatgcaaaaggaagacagaaaaagaggaaaaagaacatgaaaaccagaggtgagcagccaccagaaggcagaagaggcaagcaatggatcctgccccagagcacccagggggactgtggccctgccagcaccccaatttcagccccatgatgctgattgcagacttctggcccccagaactatggcaagataaatttctgttgttttaagacaccaagtgtgtgatttttcttacactagccacagaaatgaatgcattgtatcaccctgggaggggcaggccaccaagtctcatcatcccctccaactctgtgtcataaagtccagacagtgctgctgagaagttagggctcctttcttctgcctcctgaatcatgagtggaggctctactccaggttcggggggctgagaacatggaggcgctgactactctcacccagctcactcacagggtataggttccacaccagtcaagtcaagtgaaaaagatcagaggcttccacccccacccagtgacaagaggagtgttgtagacatttttctcaggggtagaggctactcaggagaacacaaagctccaaactccaaaggtgtctcttgaagactgaggttatttgaaatagtgtgggtaaattcaagtctaagggctatctcaaaaacagtggagattttattagcaggcaaagagcaggctgatcactctgtgggcaacaagccaactgtaggccagtgagtttaccaggaagaaccaagaaaagagccctgctgggaccagaaaagaatccaaatattatctctgtctaaaattaattttatcagactagaaaaatgcatgccccaggacattatcaaaatggtttatggttttgtttctgaggcacttgtaggtcctgaagataattgtacatattctcttctaaaaactttatatttcttttacatgtagatatttcatccttagaattgatttttgtaaatggtatgaagtagggatatagttttagttttttccacatggatttgcagtctcctaaggaccgttgattgaaaaatcagcctgttcctcactgatcacgcacacgtgaagtatacagattgtggggtttgtttctgggctctgaattctattccttggcttacatgtgtagttagttatttttgtctgcaagcatttcattttaccttggagtattatttgtgggttcctccagggacgatttgtcttccatctttccagtacctgggacaccaccactctgtctcgttgaaaattgaactgccagcttgaggttttcagaccacctaaatcttatgaattcaggctgaaaaatctacatgaagaccactggcttctgttgataaattctcagcagggattttcacctctttcctctcggcactgaggttcaaaatggctggttttctttgttatacccttgagaaaggcagatttatttccagttgaccctcactttgagcagacagctgattggggtctcagctctgtggggatttcccacagaaatctgggcctgccatgggctttgacttctgccctctgcccaccaggaagtcacgaaactggaagttcaacttcccgttgctggcaaattccctcaggaatttggcttgccttttgggtgtctgtattctacaaatgttttgacttgagaagttcttgcttttggctaaatctttaatacgtttttaaaagactatttataaaattttgtccaggttttcagtgcaagagctgatccaggtacctagctcaccatgttatccaagtgtccagtacaacccaatttttaagtttttaaattgtataattttaaaattatgaagtgtgttttgtctttaggattttgaaagatctgagagttctgtcttatcctgagaggtaactaatgtcccttccttccaactcttgcccctgttacctgagtccacctgtagcaggtactttaacatacataacgtgtgacctgctggtgctggagtggggttcacttcacttccacagtggcctctgcaggggcagggagtcctggagccctccgtgtcccagaccccagttctgactttatttgagtcaagagcctctttaagaatctgatgaggccggctgcagtggctcacacctataactccagcactttgggaggctgaggtgggaggatcacttgagcctaggagtttgagaccagcctgggcaacatagggagaccctgtctctacaaaaacttttttttaaaattagccaggtatggtggcatgggcctatgatcccagctattcaggatgctgaggtaggaggatcacttgagcccaggaggttgaggctgcagtgagccatgactgcaccactgcattccagcctaggctacagagtgagattctgtctccaaaacaaaacaaaaaaaattctgatgaaagctagacaagggcgtacagaacacacacagcagacacagtttctgttggatacaccttcagggggcctgtggatcccttgcagtgggatcccctaattctaagaccccccaccccacgcctctctatagcacttccctgtgtttgctgctggcaggacaggaggcagcaggggctagcacaggccagcctgctcagctgtgggtgttctgcagcgaacctgctgtgcctgtgtcacataccaagggcatgactaagggctactgatgcagagtcagaagtggcccagccctggcccctacctcctcccaggctcctctgagcctcagcagagactgtggccaagtagtgaagtctctggcggacatctggacctgcaagccatccagagcattgtccttggcagtggcgagatggtcaggtcagcacctgggtccttcccagcttaggcacactttttgccaggataggagcttctcaggccagggcctctcttgccagtgcaggcagtcatgcctggcatcaagtccagcaggcgcggaggggactgcaggccacagctgttcaagtgggggcctcctttctgccctgcgaggccctctcagccttgatgagatcacttgggggccttctatctctgggactccagaaatagagacagggaactgggagtgaaagcagccacatgtgcttgggcaccatgagtgctcacaggtgccagaggagcagacgggaccaggtcagggactgcagcccaggaccagccagtggggcttctgcagtgcctcatcctgttcctgccatgcctcactgccaggaaaacagccacccttgaccacctgcccaccggcctctcccaaagaagacactccgagaagcaactgctagaattttctcaggactaatagcagttgctaactgtctccaaagcacactcagctgtccttggggctcagccagccccacacataggagggacaaggcccacagcgcacaggctcagctccacagcacagggcttctgtcctgaggccccgtaagcctccttccagcatgcctttctgttcatggagtattcactttgtgattgtgtaatcaaaaatcgtcttgacaatacagcattctcccatactagacttactcagagatggtctgtgctctgaggatgatgctagcatggctgctgcctgggcacctcagagcagtcctgacacagcccccatggagccccacctcgaggagaatgggatagcctggggatcctgggcccggagtgggccccacgtgagtccagcttgctccagctgactctctgtgggcctccattttcttgtctggaatggaaggaaatgatccctccagctcataataatgatcatgtttatgtcagatcatcgttcctaggatttccccaaacctccacgtgcctgggagaggagtgagttctccagctccctgggaccctcaggggttacacacaccaccatcggccctcccataaaggctgcaccttggctcggcctccactgtgggcctggctgcaggctctcaccccagctggtaggagctggggtgaaggaggccagttcaggcgagtcctctgcaccatcctctgctggcccgatttcccgatcagcactggatcagcctgagtgcctgaatccagagctcactctccacttgggtgggagcatggctgcttcctgtcagccccagcggtgtgactgggaccagagagtctcctgcagcctgaagaattgtcccagcctgcccacccccggcctcctgtgctccaggcaggcgtggctctccgtgtggcagatctcactctttgtcagggcctctgtgtccttcctcctgggacaggcttggcctcagagggtgggagggaagggagggccactgcagccgcagctgctgcatcaggaggggccaggagtccccaaggtcgagtccagagcgcagcagggagtcccagtgctgacgctctgcacatgtggcgtccttgtcttgccccagctgcaggctccatgtccaaaagcacatggagggagagcagaggtttcctggggacagcagctgaggccaggggctggtgtgctggctcacaggctctgaggctggggatcactgacattgtgctgctgcggcctcctgcccagggagcctgctggcaaggggcccactgcgacccgggctgcatccctggccagccctctctcactggaggcctggactcacccctgccaggaggggagctctgtgctccctctctgctctgtgctccctctctgctctgtgctcccttcctgcctgtctggcagcacagtgaccacctccccaaaacccatcccggcacggaagtggggcctcagagcaagcagaggaagaaccaggggcccttggtgatacagcctggagggggccttggctggcacttgccattggtgtcgggcagacaccggcccctccacccaccagaagatctcaggcacacctgcccaccctgaaagcaagcaggcagggagtggcccccagagctgaccagagggagagaagacaggaactgtagagacaagaggagtccaccgcccagcctggggcagcaccttggaagctggggttgggctatccaactagaagggacagaagccagctgtgcggttggttggtggtgggctggaaaggggcagagggactcaggacgtgccttctgatgggatcatagggtctccataatgcattggccacaggtggatgaggaagaagttgcctcagggttgtcgtggaactcccaggagggctacgccacccccatgggtgtctccaagccccacgccacctggtttgcagaccatgggcccctagtcatgtcgcctatctgggcctttttttaaaaaaaaaaatttattttgagagaattgtagaatgagcatacaattcatgcatgcacttataagaaacgatacagagaggtctgaagtaccctttacccaatttccttcagtgataacatcttgcaaaactacagtacggtatcacagccaggatactgacatccgtagagtcaagttacagagtattcccttaccaccaggggccatccgcagccacacccacttccctccctccctccccagcccctccataacccctggcagccactcaccacttctccatttctacagttttgtcatttcaagattgttatataaatggaatcgttacattatgtaacctcccggcattggctttttttttcactcggcccagatccctgtagatccatccaagttgtcccatgtaccagcagttgattgctttctaatgttgagtaggattccatggagtggatgcactatggcttgaccattcacccattgaaggctctttgcagagctctcggttttgggctactgtgaacaaagctactatgagcttttgtgtacaggtttttgtatgactacaagtcttcatttctctgagataaatgcctgggagtgcaattgctgggtcacatgtcagttgcatgtttagttttataagaaactaagaaactgttttctggagtggctttaacattttacattcccaccagcatcatgtataggtgatgcagtttctccacatccttaccagcatgtggggttctcactgttttttattttagctatgttgatgtgtatataatggtatctccatgcaattttaacttgtatttccctaatgagtaatgatgacaaacgtgttttcatgggtttatttgccatctgggtatgctcttatatggaataactcttcatatcttttgccagtttcctaattcgcttgtttgtttactactgcattttgagagttgtttattctagatgttaaaagccttcatcggatacatagtttgcaaatattttctcccagtctgtagcttgtcttttcattcccttaacaggctctttcacagaacaaaagcttctaattttaagaaagtccaattgttttttacgtcaattctaacaacgtggctagttctagatcccgaaaattttctgctattaagaaaaaaaagctttatagctttacatttacacctaatccattttgagttagtttttgtataaagtgtgaattcattatttttgctgtgatgtccagttgttcccgcatcatttattggaaaagctgtccctcctctgatgaatggcttcatacttttgcggaatattaggtgggcatatttgtgtgagtctatttctggggtccgttgatctatgtgtgtctgtccatctgccaataccctactgtcttgattagtaagctttaatttcaaatagtgattccttccacttattcttccttctcaagatgggttttgctgttctaggtcctgtgtgtttccacataaattttatggaaaaataagcttgtctatatccacaaaaatacttgctaaaattttgacagtaactacattaaacctgtagaattttggaaaaattgacatccttatatgttgagtactgtacatgtttttttaagtttataatgaagtatttcattgtttttgaaatgactgtaaatgatattatatttttaatttgttttcacaccttcttttttaatgtatagaaatggattgatttttgtgtgttgatcttacatactgcaacttgctacactcacttattagttcttttgcagattccttgggattttctacagagactgtcatgtcatctgcaaatacagacagttaatttctttcattccaatctgcatgtcttttatttctttttcttgacatattgtagttggtagagcttgcagtagtctactgcataagagaggtgagaatggacacttttccttgtaccaaatcgtagaaggaaaatattcagtcttttaccattaagtatgttagctataggtttttacagatgctctttatgaagttaagaaaattctcctttgctccaagtttgctgagagtttttatcatgactaggtgttggattttgtcaaatgcttttcctgcgtcaactgatagaatcacatgacttttcctctgtagcctgttggtaggtgtattacattggttggtcttgtaattctgaaccaaccctgcatacctgggataaatcccaactgctcatggtgtataattccttttaaatgttgctgaatttgatttgctgatattttgtcaacaatccttgtgctgaagttcatgagaaatgttggtctgtacttttattatcacatgttgtctttgtctggttttggtatcgggcctagcctaataaaagtgttctttcctcttctattttttaagacggattttgtaaaataggtgttaattcttcataaatgtgtggtagaattctccaacgaagccatctgggcctgaagatttcttttaaatttcacattcagtgtgtttaattgttataagactattcaagttgcatgtttcatattggttgagttttggccatttgtggtttttgaggaattggttcatttcttccacactgttgaatttatgagggtaaaactgtagcgttcctttgttgtctttaaaatggctgaaagatctgtaatatctctgttttattcctgatattggtgatttgagtcttctcttgttttatctttgtgaatcttgccagaggtttattttttgaagaactagatttttgtttccttgtttttctctattgttttcctgttgtcagtttcatcgactgctgctctttattatttcctttgctctgccttgctctgggtttattttgcttttctttctcgtgtttcttgggttagtaatttcgatgactgatctgagacttttcctcttttctaatgtaagctttcagtgctgtacatttctgtttcaggctttttcagggttttttcatttgaaagtggaaggtttgcatcggcacgcggaatagagaagacaggcgtgcttgagaatgggctctgccgcctctcagcctgctccctgggttggttatttcaactcccaggggttcctaatccagaacccggctgccgtgcacaaggctatgggtttctgggaagactaaggcccctgctcagagccgaccctcagcaaacagcctttcctctcgctcctttctttcctgctccagcagtttgattctgtgattaactttaaaataacatttattttacacgattacaaaataaatatattttcatggaagaaaatttggaaaacacaaaaagctatcgagaaaataatctatctgcaaaccttgccactccaccccgcctggacctctgctcactttggcaagcaccctcctgacttctttgacgtgaatttgtttttccataagttattggggtacgggtggtattttgttacatgagtaagttctttagtggtgattagtgaaattttggtgcacccatcaccagagcagtatacattgcaccgtatttgcaatcttttatccctcgtcccctcccactcttcctctcaagtccccaaagtccattgtatccttcttatgcctttgcattctcatagcttagctctcacatatcagtgagaacatacgatgtttggttttccattcctgagttacttcacttagaataatagtctccaatctcattcaggtcactgcaaatgctgttaattcattcctttgtatggctgagtagtattccatcatatatatataatcatatatatggaatactactcagtagtgtgcatatatatatatatatatagtattccatatagtagtattctatatatatatgtatatatatatatatatatatatatatatatatacacatatatatatatggaatactactcaatcatacaaaggaatgaattaacagcatttgcagtgacctggatgagattggagactattattctaagtgaagtaactcaggaatggaaaaccaaacatcgtatgttctcactgatgtgtgggagctaagctatgagaatgcaaaggcataagaatgatacaaatatatatatatttcatatatatttatttatatgtatctatatatgaaatatatttatatatagatatataaatatctatatacaaataaatatttatgtatatataaataaatatatttatatatgtatatataaataaatatatttatatatttatttatatatctctatataaatatatatgaaatatgtataaatatttatatatacatgaaatatatataaatatttatatataaatatacagttatatattatatatctatatataaaatatatagatatatgtaatatatattttatatatagatatataatatatgtatcagagtttccttatgcactcattgattgatgggcatttgggttggttccacgattttgatattgtgaactgtgctgctataaacgtgtgtgaaagtatcttttttgaataatgacttattttcctctggtagatacccaatagtgggattgctggatcaaatggtagctctacttttagttctttaagaaatttccacagtgttttccatagtggctgtactaatttacattcccaccagcagtgtaggagcattccctcatcaccacatccacgccaacatctactgttttttgattttttggttatggccattcttgcaggagtaaggtggtgtcacattgtggttttggtttgcatttccctgatcactagtgatgttgagcattttttcgtatgtttgttggccatttgtgtatcttcttttgagaactgtctattcatgtccttagcccactttttgatggcattgtttgtttatttcttactgatttgtttgagttcgctgtagattctggatattagtcctctgtcagatgtatagattgtgaaggttttctcctactctgtgcattgtctgtttctctgctgactgttccttttgccatgcaaaagctctttaggttaattaagtcccagctatttatctttgtttttattgcatttgcttttgggttctttgtcatgaaatccttgcctaagccagtgtccagaagggtttttccaatattatcttctagaattttcatagtttcaggtcttaggtttaagtcctaaatttttgtttttatgaagtgcatgtgtatttgaagtgttcaaacacttaacagtatctcacttcacttagcagtatctcaatcatatctttgggttatcaaatatttttctaaaatatgattttaacatatgtggatatgtcataattccacagctgatatatatttaagctttaatttttgtcattatgagttgaattgtgtgaacaaattcatacatctttgggcatgtctctgatttttttccttaagacagattcttaggaggggaatttttgtgtcaaagactatgatcatttttaagattactgtctagaaaatgtgtccccaaatctactccacctggaagtatggccaaccttcctctatgtggagtattcaattattttttaaatattgtatttgcctttattgtgaatgaaatattatattttattgttttaacttgcattccatgctagtaaagcaagtgtaactctcaatgtccaatcacagatgtaaagaacaatcttgtttctctctttctggacaattccaagcccctatcccttccttggaccttttctgtggtcttttttctgggatcttttatggagactttctaggctcagtgaccactggccctggctactgctgagaccctgtggctctggtctgcagaccagaaactataaaaatgggcccttcaggtttgcagtctttgatgttcccattccctccttggccataaggccctcccacccctaactgcagcacccaccgcctggagtcacaggtgcagccccagcccctggcagccctcccgggctctgcaaggccccagccccatctgaatctcagatgttctccctggccaccccaggacaccagtatcctccattcagggcactgggcttttaagggagggcctgcctctgggctcttctcacttccagagagggcaaaacgaaaacaacatacattcagcaactcagaaatcaccttgctgcacagccagtctcctgggttcacaggtttttcctcctgtgtgtctccctgttctcctgctctttcgtgattgataagagctctttgtacaggaaggacagtggtcctccagttgtagtgtgtgtggcagcggttccccgagggaggcgttatttgctcttgaactttgcctgcgagctgtgcctgtgcattgctttgctttttaattttaaagcgagttgaagcctcctgtgtttgtttgctttcactgtgctttcctgattggaaagtcttttccacccccccattcagcatcttatggtttctttgctaacactggaactcaattgctctggaaggcacttgggggttaggggtgggggatcccattttctcactaggtagggtgtgcccccggcacccctaggaaagtccctccagccctctgcatttgctggattgcacaggaggcccagggtctcctgagggggaggagatgaggaggatgcggagaggtaccaaggggtcccccaccttgcaccctgcgaagtccccctttctccctgtggaagggaagataagcctcacctaggcgctgaccatgggtgaccccttactctgcaggtgggtgagacccttggagaggcctcctgctagtgctcagcagggttcccagacaaaaggaattgtcaccctttgggtggtggctccatggcactgcaggaccctggagagcccctcggctccggcccaggggcagagagctccatccagcctctgtttcccacctgggccttcacctcaactgtgctcgaggcaggcagggtgggggttgggtgggaaggaggcagagagagactctggagctgggtgcctgtgaagagggaggccatccttctgaagatgtcatcggggtctgaaggcacattggaaggtgcactcagtcaccgaaattagacgagggacaattgcgcagacaaggagccttcacccctgttagtcggggacacagctcggcccacgccccacctccacatctcctccccatcctgctgtggcagagcctgccctccagccctctgcagccccgaccccagtccggccctcagctcccagccccgcagctgcagaggcttcctggggaggggcagctcctggtccaccccatagcagaggtcaggcagctatcttgcgtctggcatctgcataggactaagagatccatcaagtccaattaggggaacagctccttcctgctctgcttagctgactaattcaatagcagccacccaggcctgggccggcagaggctctcccaaatccaatgaaggccttgctctgcagcccggctgccagcatcacccaggcattttgctcactcagcacagacccaagtcaggccccagccatacccaccaccaggagctcccagagccgtgctgctggcaccaggcctcccccagcaagctcccttcctcagggcttctgccctagagggaaggaaacttgtggccattgaggggtaggggaagtgccacagcccgtccaggcctgtcatcccaaaggaaggcccacagctgctttccaggtcttgtagaagctcgttccttccccggggtgctcttgctctgaacaatgccccagggcaggtggaggggcagatggaaatcagccacggggcttttgcaggcaagagtgcaggagggactctgcatgcctgggctcaggcctcagcagagcctgttgagggaagggatggaaaagagtagctatatggcctccctcatggggtcccagcccacagctgtgtcccaaacatcctgtgtgtccctcaacacccagcctggatgggttccttaactgagctcaagtcttagacccgtagaggcctggcacctccaggttcactcaaagggattacagagaccaagcccaaacctacccatccaatgctgggatgtgaggccctgccaaggggcttaagtccagctgcgacaggaggctcagagacatgagccaattatgacttattaaggacaaggcgttgtaattttttttaactgcttgatacacgtgatcaaggcttacttcagcctctatctcctgggctcaagtgatcctcccacatcagtctccccagtagctgggaccacaggcgtgcaccaccacgcctggctaatttttttattttttgtagagacagggtctcactatgttgctgaagctagtctcgaactcctggcctcaaacaatccttctgtctcagcctcacaaggtgctgggattatagacatgagacaccaggcctggccaatacccattttatagatcatttgagtgagggtgttttccctgtaactcactcagtcccactgaatttccgaggcacattctggaaagaaggcatggcatcactggtaggggtctgccccagtgcactaggacaccactgggccacggtctctctgctcttagctcactcactccatcactctcgaaatgatgtaatatgtacagacatctcaggataaataggtccatacctttggcaccttctgttaaagcagtaagttgtgttgtttatttatttttgctttgcctgcgagttgttttattgctgttgttgattaggtttttattaaaagtaatacctgcacaccatacatctcgaacagtattaaattatatgaaatgtgcacaatgaaatgtaaaagcctactcccaatatttcctctctcccagataactgctcttgaccgtttcttgtgcatactctcagaaaaacacttatgcaaattcagcatgtgcgcaaacagcgtgatgctgcccatgcttctgaggcatgctgtgtctgtgacgcctttttttaggtgtaatggaatggatgcccacgtgtggatgtgtgtgtgggccatggctgaccagtgccctgctgttggcccctgcagacaacgctccaggaaattttacttgttcaaattttacttggaaaattctgcaagtgtgttcttaggataaatttctggtagtacaacccaaaacaatgagctaaaaacaacctgggccaaaacatctgtgcaaggaaatttttaaacggatcttgtcaaattgttttcaaaaagatttccacatctttcaacagggtatgatgttatcaccactttccaatgaaaaaagaatgtcattctattttgtgtttatttagttatgagtgaagtcaagtactcttttttacatttttgtccatttctccattagggtaccttttcttattggtgcctgagagcacttagtccgtttaggaaatagggcccttagctgtcatatgtgctgcaaatatttccccccaatttatttgtttgtttattttatcataccaaagtcttacagtgtgtaaacaaacgtattgatcattttaaaattcatttggtttgggttgctcagaaaggtctttatttttttaaaaaatcatgtttacttccagtaattttatggcttaatactttagtctggaattgatttggcatcaaataactttatcaaaagtagccttattttttccttgtggggggtctcgagtcacgtcattatttatcgaatggtccctcattgttcccattagtctaaggccaccccattgcctgtgaaatttccattgtgacatctatatttggactctgccttgtaaatttcttatgcaatatcaaaccgtcttaactgtggttgtataacacagtccatttcactatcgctgtgccagccttttaacgtcctcctgtagcagttctgagttgtcttcatgtagattccacacacttgttaagattacttctatatatttttattttatgtattgcttttgtgaatgtaatcttttattccattacctctttatttagtcatggtttatgcatgggaaagccctcgatctttgcatgttatttttgttagtagcaactctgcagaatgctcttattttcagccaagtctttgggtttcattggccagccctgtacctgtgtgtgactccatcttcccttcctctcttctcctgtgtccctgtctccaagacatcagcagctcacgatcagactcctgccatgctccctggctgtgggggctgcagcctttgggctgatgtccgcttgtacgcacctccctcttctctgtctcatcagggttaatggctactgaactgccaaacacctttgcaacgtttgttaaactttacgttttttattcttcaggggttaattttagtcatttacatagctctagaaaatcatcatttttacctaagtatccaaattttctgtccagcagtttgcaaagcaggccctgatgcatcttttccatttctttgcctctgtggttctttctccttactcatttctgcttttctctcactccccactgccactccgcttttcttactccatggtaggagtgcccatctctttgttggaaggcaacagtcactctcctgtctggctctgtcccccaggagggctgctgggggtctgtgcctgtctggtgttgtcagactccagcgcggtgccattcaggcttgggagcccagtggtttctctgctgatgaaggggcccgtggccgtggtgggtgctggctcattcttcatccccaggagcagggatgctagaatggcctcagtttggggaaggagctgggggtactcctggcaggggatgtgctgaggaacatcttaccgtccacttggatcctgggggacaagagttgggtggcagttggagacccctgggcccatgagggtggggatgaccagcatactctggcaggcagtgtgtgggtcctctgaagcagctcccccaaaaacctagtggcatatgcccctgttacagccctgaggataaggtggggaggctggctggggacatggaagttggtgctgactaacgagaggccagtccctggccctgtggcctgaactctaggtgtctgtggggttctgttggcacagacacaccacacgtctatgttcatggagactttgtcactggcaaaggcaggggcttctcagcagggagggggtagagccaggcagggcagcagtgggagggctaaggtccccctgggtccctggggaaggggctggaggcagcagcagggagactgggctgttcagagggacctggaaagatattgggtccagcagagcgactttggagtccacaagtgatgtggagttggggaggccctcaccccaccccaggcctggacccctgagctgtccaaagcagctcctggtaggctgcggctgaaatggagggcctgaggtgagagagaggagcagaggggctcaagcttggggccagtccactggggctccacgaatgacctgggagaggctcagagctcgtgaaggggccagggtgtcaggattgttcacccagaggcacccctgttctcatccaggttacagaagagcctcaggtccagtgggagaggggagaatgccctgcacacagtgccagcccctccttgctgagctctgcatgcctgggtgaggggctgatgctgcacccccgctggggctgcctgccagggctctggaccctcccacaggaggccaggcctgtgcccagtggcaggggagggtgtcctctccagccagggctccagcctccctccaggctgctctagctggccccaggcaatttgaaaagccccctgggatttcctgacagtacaggcccagagctgaactgagcacagccctcagccaccaaatgggccatcagtcacccaaccctgagagcccaccccctccagcctcccctgcaggcagcatcaccctgggagccctgcactccagagccacttcctccctgaggccctgcacctctgacagccaccacaccatgcctgagccgactcagcctggatgaggtgcagtcttctccaggcctcccaggccccacgctgcagccacacaacctaccgctccatcacagttaccctaggagggggttggaaacaccagggctggcatgtgacagactggctagcccctaggtccttttgaggtccagagaagagactacagggtcaggagcaggagagactcacgcctagggtgagggggtgctctgcatcattttcctggtgcagaaacaggttggagcattgctgaggaccctgagcaggatttgagccagggtgcacccgcagggcaggacggaagatgccacatggctcacccacccctggggccacatgcagagttactgtcaagccacgtcagcacccgcagggcccagtgtgagcacagcagcgactccaagtgggtgggagctggcaagccacctgctggccagggatgcctgttcgcctgttagaggtagcgattctcgttcagagtggaccacagcctgatgacccctgctttcaagaaggaccatcccatcttaaacaacagctccatgaatacaaccctccctgggagtgcagtgaggccatttttaccaggctgcctgtaaggatggggtggaggattggatctatggattaacattccctttggggacgcatcgcgggcagatgagaaattcccgacagcttgatggtcagggtctccattacccatatatcaaggagaggaagacggattccccacgccgactgcctgcccagcctccctgccgacagccaccgctgaagggcggttgatggaggttgtgactgtccctgtgaccaccctcctgaggccctaaagcacaggagaactccaggcagaaacagatgcggggtaatgtagcccccctcagccccagctcctctgggaggggctgttttgtaaatcactgccagccccgctcctcctggcaggtaagattgaggcagcagggatgtgccccgagaaacagagctggtggagaggtttgagggggcatgtgggtgactgcctgtccccaccaaggggcaggggctgcctttctatctgggtcggcagacagccaggctgcccccagggaaggcaggggtggcgcctggggtggatgctggcattggaatgcccaggtaaaaccctgactccatccatgttatttatcctctctgagtcttcactctgtcgtccatgagacaggggtgattgtatgtgaggaggaaacccatgtgcctgagaacagcgtggtgaggagcttgcacatgtggcacagagacggtgcgcttgtgattaggtggcctgagggaaggagtactgtggctgtgggtgttgggctctgctcctcagaagaccccagagggcaggtggctgagcagatctccagagctggagtgcccaagtggattctggggtcaggaaaggaagtgatatgattgggggccacagtgggacacttgagccatgtgtccaaagagcctctgcactcacagagccctttatcttgtggggcagaacactcccccaccatgaggactcttctgcacatttcagagggcaggactgcaaaacccaggttccacctccctctcccattttctggtacagcatatggtaggtgctcattcatgctgagtgaatagagagctgggcaaatgctcactggcactgagcttcactgaacttctcacatgctactgtgtattgaatcttgtacatcttgcagagcttcgtggttgaccaagcacttgtcatccttcactctccttgcttgtcccgtatagctgaggaatgctgggcacaggcaggcaggattgctgtcgccgttgtacagagcacaggctgcccaactgcaagggccgtagagagcatccaggtgccatgagcaccagaggggagtacctggcctcatggtcagagaccaggtctagtagaggaagggagacagggatgctctcattctcagagcagaatcctttcttcacttaacctattttgttagcattaaaaaaagagaaataggcttgggccttatttatgctcctggtttttttaaattgttttattaatatctactctttagtacttctttacctgctttttgcttttcaatttaaatacacttaagtctttcttgttgtttaattaatgtatacattgaaaggtgatatgttttcctgtaaatactgctttagctacattccacaggttttgctgtaatttcctatcctacaatgctgaatgatttgaaatttccatcttgatttcagtcatttaggaggatatttgtaaatttccaagcatatttttatatacgtatttcttaattgcttattttcaatttattacacagtcagagagtgtgtactatatgatatcattttttaaaatttcgtgggacttcctttccttttacttcctgattttcctaattttttaatctcattgaaccatccattactttttttttttttttttttttttctgagatggcatttcgctctggtcgcccaggctggagtgcaatgggtgcgatcttggctcactgcaacctctgtctcctgggttcaagcaattctcctgcctcagcctcccgagtagctgggattacaggcgtgtgccaccactcccagctaattttgtatttttagtagagacggggtttcaccatgtggtcaggctggtctcgacttcaagtgatcaacctgcctcagcctcccaaagtgctgggattacaggcgtgagctactacgcccagccctgagctatccatttctgataagaaaatgttttaaagcttacactgaggtggcaaatttgtcagtttctctttgcagcaagattatgttattaagtgcgcacaagttcatggttagtgagtcctactggtaaatgcattgtagtgtccctcttcatcctcatgagtgcttcctgccttcattctgtgtccgttgttagtaatcccatgtcagcttttctaatgttttggtctcgtattttctgggtatgtcttttatccctttgccttttgctataatttggtttaggtgcttctgtaatgtcaatttcattcatgaggaatcaaattctgctctgttacagggaccctagctgatccccaacccttaggaacagagagcctagaagtatctatgctcatgtccatgtaatatacacacgtgcccacacacacctcacacagttcttacactcacacatatacacactcacatatacacttacacgctcacacatgtacacatgacatacattcatactcacacatacacacccacaaacacatatatactcacacatatacacttataccacaacccacaaaaacacatatacacatgacatgcactcacacacatacatatttatgcacacaacatacattcatacacttgcacactcatgtacacatacacacttatacactcatgcatatacacatacaatatacacacatatgaacacatatacgcatgacatacatcacacacatgcacacttatacatacaacatacattcacacatatacactcacaaatacacacttatacacacaacacactcaactacatatacactcacatccatgtattcacacatactcaaagcaattttaatttgtaggaaatctcagtttaaaaatagctgcagttcctacctgggcatcaggtaacctggaagagaggaaggagaggactgtaattagcgaaattcatgattcgaaaagaagccttggcaaggactggattcgagtccttttgtgaccctggctgggcgagactcatctcttgggagcctttgttttcctccctaaatggggatcacctgagggcacctcctgctgtgaagctaccagacaccctgaggggaagggatccctgggctcctgtcaggaggatgtgaactgcctgggtgggggcagcattccccctacttctcccctcctgggtaagaggctgggtctctggggcaagtggagtcctggcttatcagtcagccacaccatgaacacccagttctgcctccaggtgtcaaataggcaatttaattaaacagaaattcagcagccagcaacatgacgtcatagttcctggaaacagaactgtagccacaattctagtagctcattctgtccttcaagagtttaaaattttttaatgccggagctccatttgatcaccttcacgcggccctggtgggtcaggcccacctgctcgctggcagcccctccttgcctctctgtggtcccaccagtaattaagccttttaagagctgggggagcttcaatatcggtaattcaatctccccctgtttactgatctctgccattagccgagttgaaagcaaaatgttttaattaaaaagattggcaataagttggtgtaatgccataatttgcacagggccccttctagaggatgacttcgccctgcctcagttgctatgacaactaatggacaagattgttccagtgtgagaagcagcatgaggaggggacaggagtgggaagaggggcctctgcaggaggacagagctgtgaggtggaaagaccaggcctctccgtgagctccagggaggtcttgcctctttgttgccatccctgtggctggaagagtcgtgtctctaagtgcctgggccaaggttgtcatggccagtgccatctgggctcaatggtccagtacagagcagagggcgagactcagcagccattcaccctggagtgtactggggccccgcctctgaacagggcagctgtgcggcgggccaaggcagaccccgggtaaatgtcaaataaatgcccctcacctcccctcccacacaggggccaggtaaagggacgtccgcatgtcacctgcctttgtgtgctgactgtctgttgggacacccaggggccaaggtgatgtcctggagaggagctggctcgggaggcactcaggctgcagtctccttccaggactcccaggctagacagagcagaagatggcaactgctctgggtgccccacagctgatattcactcacttctctgaccatggggccagatcctcctgaagaggtaagccctttgtgggagcggataaggcgaggccttgtggaaagggaccaggacattccgagtcttgatttcctcatctgtgaaacgggaatgaaagcatccttctctcagagtcactctgaggactgacagaaaccgcatggtgggtccaacatcctctgcggctatgctagtggtgtgggtgtgccttgaggagccatggggggcaggggccctcgccagtcagctgctgtctgcacccagggccacagggcaagggtgggctctgaaagagcaggacaaacagccagaggacttggctccccgctcctggaggagggcaggtctgaccagccaggagcaggttggggtgtggggtgaagcagaaaaccaaactcgagtgaaatagaaaacatggaacagttgtgcgtcctcacactacagcactagtacatcttcacactacagcacttgtgggctgcggggccctgcaactgccagtgctggggcccggtcttctgagccacagcaccacgtgcagcagggacgtgatggctcaccccgctctcccctccaccatgagcgcacccacctttcctcaccctgccagggcaggacacacctttgggggcgccccaggacatccaggttttgaccccacaatgctcaggaaggatgacttgtgagtggaggctgggccattctggggggtatgctgaggcgtgagcccaaaggtgacaagtgacacatgagagcaagtggcaccaggtgccattcactcagctctgcttgggaagcccccctggggtggtagacagtgtcatgctctggtattctgtgctgtgaccagggccacctcattcccatacaggcccccagatcagtatctccaccaaccatactcaccatgggtgcaggaacatcagctcctctcctcctgagagtcactgggcagcgtgggggcaggcgagctggaggaggcgcagcttctggagctgggaggccgggtgctcctgcccgggagcccaagggcccgtctgacctcagagagcctccttatcagccgcggggagggcgatctatcacgtggcccatgctggtgtggaaggacaataaagcagatattgaccgtgattctaatcgggtgagctgggcctctcagccccacagaacacagcatgccgacttatgggttcagacgcgagaggagccaagcctgagcaggaacgagataagaacatgccctgggtgattcaatttaatgcaaccgtcgctcccagcaaccttgatttgctaagtgctggggagcccagagacgaaggagacagggggccagcatgttctggtctgacagcaggcacagggcctcgccctggtggggtcagaaggctaaggggatgtatgtccttgaatccactgggcagggaagggcaggggggtatgtgcagctgcctggaggaaaccccaggccccactgagccatggggagcaaggccctgaccagcacttgctgcagatggcccctgcctggagccttcccacctgctcctctgcagatgcctcccctctccctcaccaggaaagtcagggtatcccgactctgtcccgtgccaattatgtgctgtcatccagcccctgcatggccagtgccaccatgggccggtgaccgcgacaccctccacccacgagccaaccacacactctaagcctgcttgaggcctgtggcacctggtaccctgggggccagaactgttccaagacccaaccctgatctcctccctgtttaaactggcttattcctgctacttgggtctaaaaccctttgagagctgggcatggtggcacatgcctgtaatcccagcactttggaagaccgaagtgggcggatcgcttgagcccaggaattggagactactctggagaacatggcaagatgtcatctctatcaaaaaaaaaaaaaaactaaaaaatgagccaggtatggtggctcatgcctgtaatcccagctattcaggaggctgaggtgggagggtcactcgagctcaggagtttgaggccagcctaggcaacaaagtgagacctcatctccataaaaactaaaaaatttagacaggcatagtggcgtgcactggtagtcctagctatttgggagactggggcaggaagattgcatgagcccaggaggtcaaggctgcagtgagccaaggtcgtgccacttgactccagcctgggcaacagagcaagaccttgtctctaaataaataaataaataaaacccttcgagacccccacaccatcattccctcatcccccacctaacccaaggatgccctattgcccatcttcagaatgcaggcaaccctcacctgcattccttcctcaactgcatgcacccccacctgacccttcctcacctggacacattctcacccagctctctccctggcaccatcccctcagctgtcatcctccacagctctctggagacaacttcccccgtgtctcctagccctgccctgccccttcccgcagcagcagaagtttctggagtgtgcactgggtcccgctgcttgccagcttggtcttgctgccatccaccatggcagccaggccaaacccaccctcctccctcctctaaacacccctggccggcacctgcttaccctacagtctcatctcctctctcacctgtcacatgctccccacatgcagctcttgccgcctcaccaggttccttacattcaccctatctccgggcctctgcacgcactgtgccttctgtttagaagcatttatcctgcattccttttggtcaccttccttcctccatgcagaccttgtccctggggccctccctctggcccagctgcagcaactcctgcctagagttcctctctgtaacgcacttaccctgagtcaattctcgtgcttgtgtacgtgccccttgccccacaccagctgctccattcggtctcatccaccgttacacatgccacacccacagcagggcctctgaggcacccagtgccacagccacaccagctggatggctctctgtgcctcagcctgctcatctgtaagatgggggatcattgtgcccactcccagggctcagtgagggatgcacccaggtctttaggacatgctgggtgtgatggttcttcactcccttcgtggagagctgtgtaacctgcttgggatgatgccatcaggaagggcagatggcacagggtcataaggccacggacacccagctctgcttggagcaaaatctctccagggcactgagacagaggccccccaaatagcccgcctgccatcttccctcacgcatggtccctgtgctctgcctggcccacgccttttttggctggggctcaggctctctgtggagtgggggctgggggagcaacagaagaggccttgttgagggtcccaagggtccccacttacatgccacacggaccccagtgcagacccatctcccaagagccaggtccctgattggatttagctctggcctcccagcacctcacgcccatatcccctggcctgtctctttagaggataatcagaggaagtaattctatttgagaaacaatcactcctgtggtatgatggtgcactcgatgttaatggacccagcatccttgcatactaaggacgcatttcagccaagcacagggtgtttttcgagaaaggtcttgttccccatcaaggctctgccctcactgagctattagcagccaggctgaggacatgagcttgaggggaggtgcagactcagaggtgctctgtgcactgggctcctttgggcactggcagacagggcagaagttctgcctggggaactcgggctctggcaggtgttctgtacacccacctggcataacatcagcctgccctggtgccatttccattatcagtccatcttacaggtgaagacactgagaataagagaaaaaaggaggatgtccgtatccacacagctggtgagggggagctggaaaccctccagaacattgctcccgtgctcccccacttctgctcaccctctgctgactcagtttcccactttctgcctgctcgtggtgctgcacccgctgccaacataactgtaaatgcaaaaatgatgatgccacaccttcccacaaaattcttcaccatgtttccaaggcctacagaagacgctggagctctgggatgccagtgcatgggcacgcgccaccaagacaagccccctctaccttggacccatctcctggccaatcatacctggcaggcggccctggcccagccatactgcaccccctgcagggtcctgttctggcctggggacttcacacttagccttggcaagtgccacccccatgagggaaaggctccccccacccctcgtgtcctatctaggtgacagccactcgcccattcaggaggattctgcctgagcacctcttccccgtcaatgtcactccccgagcctgggcctgccacagaacctgccacgtccacgcaaggtcctgctcctgggtctgctcctcatctgagcggaggggagaggcttctccaacgctggagagagtgcagcctccggcagcctgtggggccacagggcctggcctgcccagctttctccttcattcattcagcacatacccattgaggtcccactgcctgtcaggccctgctgtgggctgccataacaagataggttacaccggcttgagcaaacagtcatttctaacagttctggaggccggcctctggactgggttccagcagggtcagtggtggtgaggcctctcttcctggtttgcggccggctgtcctctcatgacatcttcccatggtggagtgagatcatgccccttgcatccctccttataggtgcactaatcccattcatggagtctccacgcccatgacctaattccctcccacagccctcacacccactgccatcacgctggggtttgggctttcacatatgaatgggggtcacagataatcagcctagagtgggcactgggacacagcagtgacaaaaagacaaaacctatgtccccgagggcccacatacccactgaggacagaacttgccgaggtgatgctgagccatgtggacacctgggggagatcatgccaggcatgggggacgccagtatcgaggccctggctaggggtccctggtggatcagtgaggtgcccaagagagcagcacatggctggagcagtggcacagtgggttctgacttacatctcaggagaatcctgttgtctcgggcagagaacaggaggacaggctgcagtgctggtggacaggaaagtgcagaatgggccactgcagagatgcagcaggtgggcaggaggtgaggggtcagattctgggaccacgggaactgctggtgcgtggggtgaaggaaatgagagaagccagcacccagggagacgccaggacctgtggcctgagaaactgggagtgcagggctatcatcagctggagtggggcgagggcaggcctatggggaaggaaatggggacaagtgccttttgaatacctactggatgtccaggtggacttgtttgtaactggacattgtgagcctgacctgaggttcctgccctgagcccccatccccggcccccttgcagggtcagtgaggcacgagcacaggggtcagtcctagggacccaggcctggccctcaggggtaactggtgcccatgttgccctcaagggctgtcccctggtcttggagaacattccctgagagctgtcccctggccaaggggaagtgagggacacactagtgcctctcatgataccttggctggagcaggggcttggaggggcagcctggggccctcaggttcctgctccccaccccatgcatctcagcccttcactcccagggaagctgctgcatgccttccctagaatctgtcccacagggggtgaactccctgcctgtcaccactgttgaaggatgacttttcttctctccacaagccagggaattaattcatgccatctattttactgagtcggatcaaaggttgtcaaattccttcacccacttaatgatctgtaatatacccttccatttcctgaccaggctattagataaaatagaattcataatggcctcctggcagcatctgtgcacctgtgtacatgtgcagggtcagtcaagagaccctaggatctgctcagccaggatgtatctttttttccaagagattctgcaaatctcaatccatatggggcttttagtgccaaacatactctatggtctgtgtgaggctgaaaatatatgactcacgagtcaccactgcccttgccctgtccgtggtagacattattaatcaattacaggcactcttcaccactgagctcagatgtagctccttccacagccatcacacatgatacatgtcctggccggggcaaggaaacctcctgaccatccagatgagagacattaattgatgctgctcaccacactgttgtttctccttttttttatgtgtacggtggcctctgagcaggggtaatatgaggtgaccaggatccccccgctgagcctcctgcaggctgcttcagtgggcacagcccatgatcctactccacagtcaggaatgagcaccccaaacctgccaagctcccacctcacaggaggtctattgtgtcagcctcctgagctcctaggcatgaaagcaccttgctggacaaaggcagggattgctagcaggcagcagcacacaggcgatcatgggaagacccggggccctgcccgatccaccacacacccacacaccagtcatgctccatcctgtcacaatatcaaagaggaagcatcaaggctgacagccacagctgaaaagagctgtgcacaaccgccaccttggtccctgtgaggggtctggtcactggcctgacggtgacaccttctcggggtacagagtcccagactccctgttgttcctgtcttgggagcagtattggcgctggcctcaggccacctgggcctctccactcccttctcccctagcaggcctcttgctcagagctcctacgaggtctcctctcccagctcctctgagctgggctgcaggctgggtgtgtagagaagagcagaggaggctgggagagctccctgaagtcacgttactgtctgctcagctcagagagaagagcttcagagacagggaggactgagttcaaagggaagccctggggctggaggtgaccctacctggctgccgcagaggactagccacatgcctgccacatgccaaccatcgtcccctgtcactgcagcctctgtcatgtcagccttcagctccctggagcagtgaggcgggctgtcctcgcccctgcctcgacctgagccttttaagcaaatcagcaatgtaattattgatctgtaaaagaaaaggaattaatatggccgcccacatcctttgtacataagagtatttaacaatgaactctgcttaaacttcataaaagcctcttcagcaaatcagcacagaagtatcgatctggaagctggcctgtgaattccagctgactgcctctcccactgaaggaccattacttggtcttaccgaatctcctctctccatttatggctgggcgcttcctcctgggacgcttctgctgcctctccacagggactgagctgcccagttttgctgatcctcccttttcctggagtccagcgtatcgactggagagagtactggggaggtgctcttggttggggctctgcagccaccctgggcctaacaccccaggctcaggcctgccctagagacccttggtcaccctgcttttcatggagcagaagctggggtactcggtgtgcaccctcttgttcaccctcccaaatgggcattcttgcttcaccttgcagggtcacccagatgctgggggctggggccagccttccagccaatggctgagcgctttccttctcagatatgtgagttggggctggcatcacccacaatgtagcaagctggacccactgccactgaggccgtgggctctccctaatgggatcttgtccaggtacccgaggaggccagtgagtcagcaggctctgccagagcacccaccagccctggcatccagcaagatggctttgcccttggagccttcccatccaccctgggcccagcctgccagttactctgagcctgtggctgtgcatctggcctgggaccctgtcctgtctgctgggtagtgtcagggtcccatgggagagtcagtcctatcttgaagcaggactctgagctcactgccagctgctcagggttctcctcggctgcccagctctaggagcagaggcctgaaccctgtgacctctgtggggccacttgcagatggggcagggatgggctggtggatgagatggggtggctctgcagatggggtgggggatgccgacaactgaggcagtgagtgcagtggcaggagttggggtctctgggttgggcctcgtccagggctagcatctagggggtccagaacccccttcctctctggccaccatggctgcctttgtgaaatgagctctggccttggcctctaaggcccctacagccctgactttatgcatagcagcagaacagggtcagagagtccaaaccacagaccccacgtcacaggccagcccctcagaaatgcacagtgcctaacaggaacagagcctccaacacactgggaagtggctgtggtggcgtccgcccccgctgatcatgtcgtctgccctgcaccctcccacgcctctgcactggatgcaagctcactccacatgcctctctctgccgtggctcctgccttgtacctcctcctctctgtctcattcttcttgtctttgcctccttctctgtcagtttctttgtttctattttcttctctgctggcccctgttttccctttctctttgtctctttctgatctttctctgttaatcctgacgttctggttgtctttctggccacccccacgaccactcatgtccagcattccctggatcagggtgggtgaggctcatgcccaggtctcaagaggaggtccgggtgctgggccctgcctggcaacttggagaaggctccccttgagaacactcactcctccagggggatggaggctgtgggggcaagctcttctcagagcaggtgcacagcagtccctcctggccctgcaggtcttgctggttgccctaccatgagccacatcttggggccggcagtggggaggaggagacctctgtgctggccatgatttgagggacaccagaggactccaagggtgccccacctcacagcatcccttccccaccttcctccaacctgctcctggctgccaatggccaggacaggtcaggtcaggtgaggggtgatggggaccaccagagggctgcaggctgccaccccctccatccagctgccgaccagctgggagaggtgctgtcctcacactcacacaaagccttggtgagagaacagagagggatgcttgcatgtggcattgcacccctgggaagaggagcaccccaggaacttggggtccatgcggtccatgcctcggggccctatagcctggagtctaggtccccaagctcctccaggccaccttgagggcctctgccaacacgcactgcctcaggagggcatgcaggccacagacaaggggcagggcctcagctctcactagaaagaagccgaggagggggcctctgaggaactggcgggggtcccacaggcaggacagcccaaggtcatggcctctaactcagagggggcctctggaagcgccacgttcactaggcacgggctggaggcagcccgttcactagggcggtctcccgaagacgtatctgttgcaggggcagcgagaattccaggggaactctagaaaatgagtggcacctgccctccttgtgactggtcaaggaatattggggcctactgagcatgcttggggtaccctcctctgcagatagcccatgcaggtccaggggcctgatcccacctgccacccccaggctgggagactcagagcccatcagtgctggtgtcagaagaggtcgcccctttcctgacccctctgcttcctgccacccggagatcaaaaggtgtctcctcggcggttcctgtcaccagccttaatgcacgctctccccattagcacaggggctgggaggggaggcagccaggggaagatgggagcctcagatctgagcccagaggaaggagacaggggtgggaggtctagggaagattcagcgataggcctgccctcctgcggccctccagacaccagtcttagagccctcctgcatggggagacatggggcatactggggaagggtgaggtcctctctgagccccaccagccctgacttgactgccgctctgtgctgagtgctccccgcacacggctcctggtgacagcacccgtgtgctagtaccgagccacagggtggtcacagatgctgtccgtgtggtctccagcccgtgtcagtggggaagggcccacagtgcttttctgaggccagagcactgtcattgcccctcgaagaaccagctaatggcagtttccagactagaacctggtctcctcgtggcctgtgcagggttggggtgctcagcccagcctcagggggtcacctacaccccacccccaactgcccgtaggcccagggagctggagagcttccctgcctgcttgcaggcactcacggccctgtgacacacacacactcatccccaatgaaggtgcacccctgaccaggtgtggaccccaggccaggcagcaaagagacagctggcctgacttgggtcctcagcctggcccagccccagccgccggcttgagcaagcccttcccgagaggtcaacctcccatccagggcgtgagggttgcagcctgatcccaccctgctgcatctgccctgtggagccctcgtcctttttccctggggtctccctccccgccaggccaggctctaccctcagggccggaggcctcctgggggaggttcatgtctcactttgcagcctccagccagatggcctccataattcattttagtgaaatatggcaacacttttattggcgatgatcctatctggagcctggggacagtgatggccagaccagggctggtatctgctttcacagagctccgagaaaagcctgcatggttatgttcgcggatgtgcactcatttcgcgttgctgggagggggggtggggcagggcagaggctgcctctgggtctcctgattccaggcagtctggggcaggaggcccacaggcccctgcactggcctgacagaaggctcgggcccggggcagaggggtgggctgcaccctgcactgatgctcagaccaagctgagaggtggagaagtcaggggatatgcaaggtgatggggagcagctacccagagctgtggggtggaggccatgggtgccactcagcccttggaggagctgcctcccaccacctgcagcaccagagtggccctgctgagctgcaggctttctccctgcatctccagctcacactgttgtgtgctctgtgccccagggccagccccataggattcagaggccaacctcacttcctctgcactagcagcccagagacccctgcctgatagatgaaccccaaaactgcagtctcagtaggaccttagttgcagtcacaagtccaagaggaagaaggagaccccattcctggtcatgctgtctgccaggctccagcccgtcaccccttaccgtagccagcccagacctggtgcatggtggagcatctacaagcagaaggtgaggcgtccccaccatgggtctgctctgcagccctgcggatgtctcaccagcctgtatggggtgtgctcctggggacaccaccttggggctcctccagggagctgaaagagggcaggcctgggggacacgagatggacagggacctgagaactgcccatggcaccacccaataagcctgcacctatcccttcatccaaacaggtccaggaaaaaggcaattacatccccaagaaatgtggccagtcagggagcgtgagagcttgtgctgctcttgggggccacagagacccacctggctggttctggatgagacaaaggctgcagactgacacacctatgcaactctcctcctgcccaggtgagatcagtcccaagtgtcagcatgtcagccacccccaggagggtcctgggcatgttatctgacctcgctcaggcagaggtgaggctcagcgggtgactggggcaacgagacccagactagcgggaggcaccagaagggatgcaggcctggacagggtgggggctgtgaggccccaagtgtgcccggccaggacacagctgtgctttacttcccagaacggatggccaaggtggtctcagacaaggctgtgcctctgagctacattcccacagagacttcagggtggcagtgcagcctcagcctgcgccagcacccccaggccttcccgaggtgcctatcgacctgctgaacccagctaatgggctcctctgggcattgagttcagaggcgaggttgcctgtaagcaagattcgccagtgtgcttcatcagcaggcagcctcatgcaatatgtaacaccacattaacctgcactctcagggtagacagagcccccgccccggaatccggaatccggaatctgctgctatgtagaagtggcctgggacgggaggcagagcctgcaggccctgtccttttccctgtacttccatctccccactctgtgtacatggggtgggcagcaaagctggcgcttacaccatggcaccctcccctccacctatggcaggccttggaagtcaccggcaacccctgcccctccaaactcagacacgtcctcaggatctctctcaacacagtactgcaggcaaccacaactgggcagcccaagtgggtgagcaagatcaatgcggaattgcaaggggcctcaagtagcaaaaacaaccttcaaaaagaagaacaaagtcagaggagttacactttctgatttcaaatttactacaaagctacagctgttaaaacagtgtaaaactggcatagggatagacatataaatcaatagaataaaattcagagtcgtttaaggccagttaatttttgtcatggatgccaagctcattcaatggggaaagaacagtcttttctacaaatgttactgggacaacttgatttctgcatgcaaaagatgaggttggacccctacctcacactataggcaaaaattaactcaaaatggatcaataccctaaatataagagcaaaagctgcaaaactcttagaagaaagcatagtggtagatcttcatgaccttggatatggcaatggattcttagatatgatatcaaaatctcaagtaagaataacaataacaacaaaaaacagataaattagacttcatcaaatttaaaacttttgtgcaccaaacaacattatcaagaaagtgaaaagacaaccacagaatgggagaaaacacctgcaaatcatatatctaataatagtttaatatccagaatatataaagaacttctaaaactcgaaaacaaaagaacaaaacaaccaaatttaaaaatgggcaggctgggcatgtagctcatgcttgtaatcccagcacattaggaggccaaggcaggcgggtccatttgagctcaggagtttgagaccagcctgggcaacatagtgatactccatctctacaaaaaatacaaaaattagccaggcatggtggcttatgcctgtaatcccagctactctggaggctaaggctggaggatgacttgaggctgggaatcagaggttgcagtgagatcatgccactgccctccagactaggagacagaatgagaccctgtctcaaaaaataaataaaaataaaaataaaataaaataaaaatgggcaaaggatttgaatagatgtttctctgaagaagatgcacaaatgccaataagcacatgaaaagatgctcaacatcactaatctttagagaaatgtaaattaaagccaccatcacttcacctattggcatggctataatcagaaaagctaaaagtaacaactgctggtgaggatgtggagaaactggaactcttgtgcattgatgatggaaatggaaagtggtataactgttgtgtaaaatagtgtggtcattcctcaaaaagctaaatgtatagttaccatggaattgtgacccaataattccattcctaggtatatactcaacagaattgaaaacaagaaatcaaaaaatgcttgtgtcccaaagtttatagcagcatcatccacaaaagccaaaagatggaaaccaggcaaaagtcaaccgacagatgaatggataaatacagcgtgctccaccacacggaatatgattcatccgcacaaaggaacaaagttctgacacacatgacaacagagatgaaccttgaaaacattatgctgagtagaataagccagacacaaaaggacaaatattgtaggattccagatctaaactaggcaaatttatagagacaaagcagattagaggttaccaagggctaggggtgggggatgggaggttattgcttaatgggttcagattatctgtttgggatggtgaaaaagtttgcagtgcacaagagttccagttttggaagtagatatcagtgatggttgcacaacatcgtgaatgtaattaatgtgaattatacacttaaaatggttaaaatggcatttttgtgatgtatatcttttgctacaaaaagaaccattttttaaagaagcaatggtgagcaaagttggtaaatctgtaggtagatccaataaagccttgacaattcaaagaaaagtaataattaatttatggccatacaaacagggtgaggctagtactccaaacagcaaagcctagcatgcccagtaccgggcaaagagcagggggagacacgggctgtgtctacacaaggagcatgcctttctagcacaggtattaaaactttaggacaatttattaaagaaatagaaaatatgatctctgtgttagtttcctgtgattgctataagaagttaccacaagtctggtagtttataacaacaaaaatgtattctcttgcaatcctggaggccaggagacagaaatcaaggtgtggaggaggcagagccatgctccctctgaggctcgggggaggagccttcctggcctcttccagcttcccacagctggcatcattcctgagctgggccatgtctctccaatgcctgctctctgtttacagggccttgtcccctgtgcaggtctgggtcaaaactccctctgcttctcttttataggatacatggtatttagggccctggatgacccaggacatgctcctcctctcaaggtccctcactcgatcacatcttttgcaatacaggtgatattcacaggttccagattagacatgggtgtatctgtgggagtcatgatcagcctaccataacttccaagcaattgggaagaagaaaaagaatacagaaaattgagtatttctaatagaagttaggaaaggagagagaaaatggaagtccagaagccaggacaaaaaaataagtggtggaaataaattttcctagatccagagaaaacagtaaccatgaatgtactgaacagagactgtcagattggacacaaaagcaaagtcttgtgtcagacgttgcttacagaggtcacagtgaagtatagaaaggtagaaggcaagagggtgtggaaagccgtggagtgtaaatacggatgggatgaaagttggtgtggccgggccaatccccaacttagacttaaagacacagagaatccctgggaatggagacagcgactcccagatgatgaagcagcagagagatcctccaagggtgagtgacctagagcactttaccagctttgtaaaggaaaaggcatttgcctggaggctgcagggcccagtccagcctagctccaggacagctccaacccatcctcccatgggtggggtgtccctggtccaggctagggacggtccagggtgggttggcaggacctgctgtgatcgtgaagttgggaactgcctaaaccatcttctcagagcctgtgtgtccagagggaaaacccaagcacgtggaatatggtttacaagccgtggttgctgaggacaaggttggtaatgaaggcgcagggaagcctgggagggcagaaatgcacaaggaggggtggggctggagcccggctggtcctggtatcctgggcttggggggaccctgctcctttccctgggagccctgaggcctcaactggatgacaggaggtggatatgctggtccctgaggcacaggcagtatgaacctctgcatggagctgggtctcagcagaagcccacccaagcctggagtttcccagccagggatgcacctttttcatcccagcagcctctgtccctcagtcctgagccctcaggggccctcagggcatgaaagcaggaatcccaaatccaccttccagaattacacgggctgttcttggtggtcaggtggcctctcggggccagggtcctttttaagactggaacctctccaagctcaccagcactctcagtgcacgcacgcacgcacacacacacacacacacacaccaggattttaaactcagtccaacaaatctcagcatgcaccagaactatttcagcattttaagagcctgtattgattttggaaggagccaggcagcgtgtgaaggccattctgtctgggatcctatgctgagtctggggtctctgtatgagggattatccatgtgtggggagccttcccccttcagagctttccagcttccctctgatcacatgtcctgagcacactatcccaaacctaaccccagctgggctctagcaagagacgaggtcctgtcttgctgggaaagggtcatccttcccacccggaggcccctgctctgccccagtttcctgccacaaagcccagacagtcctgggaacctgggctggtgagtccctccatcaccttcagaaacagccatgaggagctggcagtgggatggcctgggggtaggagcgtggcttctggagctagaccacatgggttcagatcccagcggtgcctctaactggccacaggaccttgggcagtcagctgaccctgcccagtcccagcatcctcatctggtcttagctaacagggacacacctgaggaggtggtcttcatgtcacttccactgggaccagttttcagagcagctgcaggggtcatcagttaaggcagtacagcccacttacagaggaggcgggtggcttggggtgtgaaggacgtgcccaggtgacatgctgctgagtggccccaaccccatccaggcaccaagccagagcctgtccccagggaccccagggcacatcagcagaagctggaggatgtgggtctcctgggcctggaatctcagagcccacattggttaatttcacacgtccgcttgactggcacacagggggcctggatgtttggccagacattatgctgggtgtgtgtcaggggggctctgggtgagatgaacacttgaatccatggactgcaaagcagacagcctcccagtgtgggtagacccatccaacctgtcgcagacctaagctgaacacaaaggccaagtaggagataattcattctgcctggctgccttaagctgggagcttggtcttttccaggcttcagacctgaaccgaagtacaggctcttcatgcatgtcaagcccctggccttcagactgggacaaactccatcagctctcctggggctccagctggccagcagcagatctggggacttctcagactccactatctcatgaagcaattccttgccatccatctcctttaataaacacacacgcatcctatcacttctgtttctcgggaaaaccttaactaatgcagagcccgagagtggggcatggctcagggctgctgcacccaggaagcatctgtgctccctgtgcttccaggcagggaccctcatggaggggtgggatggtcgtacttcctcagccagcacttaggggccgtgaggtccatagccatgagctgagggagtgaccccacagtttatgtcactgtggagaaaggctccctgagctgtggatccagccagtgggttgtaaacctgactaagacactcaagctgctgcggccgggggcatgccacaaacccccagtgagcctcagtttccccctgtagaacaggggtgtgagagcagtctcctcagggtgtaaagagcccagcaaatgccgggcacagctcataccagataagcattagctggtggcagaaaagctggaagacagactgctgacctccacaaaaggatcagatttgtgccagtcctggccatggacaacaggtcccaggcttgacctgtaggtgaagagcccagagcccaggaccacatgccaagtgggaggctcctggcccagaacaccacacctgcctagcagatgtgtctcctggaagtgggaaagcaggactctccagggagccctggggatacagaggatgcagcccgcgaggccctggccttgaagccttagtgtctctgcaggccccacctgtgattggcccctccagggtcacccaggagggtaagatgcccagggcctgcatctgtgctgtgggacacagcctggcttctgaggcccatggaaacctttctcgggagcttctcaggaccccagccaggacatctgtgcctgtccgtgacagctgccctagaactggccacaggcctatggctgccttgcactgtcagcccccaacgcccgtcgtgtcatcagcatgtctcagatgccttcaagggctgcccactccatgatccttgtccacagccccagcatgtcccctagcgtcagaagtgtccccggatcctgcaagccaaccacataggacgtccacctctgagcccctctgttctcctaccctcctgctgatcacagccctgctgcctggcctcatggtccagtgcatctttctccctggagctgccacagtgcaccacctgcctggctatgcattggtgacccctaggagctccagggggaccttcacacaggcccaggacaactggggagtcctgcctgccctcctttgagtccagaagccctgagccaggctctcttcagaggggtggaggtcagcaggcaccaaggcctgcagtccccaattctcctctcccagctgatctctcttgccacaccctgtgctggcccatgcccgtgagtccgcctggccacccagacgggagctgatgtctccaggagacatacgggacttgccatagcccaggccagggcagtccctgggagacacagggcctgggaggctgcttcacctgcggggctcctgggcaggtgcagtgctccctggagtccatcctgggacctgtggcccagcccacctcagactggccacaggccctctcctgagaacccctgcctaggctctgtagccttagagcctcacctagaagctcccccaggcccctccactgggcagtgctcagcgcccacccctctctagtctagattttagggggagcctgggtccaggctgcccagcccagcacatccccaatacatacccaagccagccatgattgcaccatggggccaggggcagtgggggtggtttggggttggtggaggcatcagggcctgggtcccacagccagcctgggcctcccaggccattgagccctcatccttccagtgctctgcgagcaggcgtccctttgtgtgaggacacctgtggtgcaccccttcagtcaggcatccctgcaacccacttgggggtgcagacatgaaggagcccatgggaggcagcatgatggccctctacatccccaggctcctgtgctccttcctttcagatggcattcattgaaggggcaagtggaagaaggacgggtttcccagcagatgctgcaattcagcccctggcttgggatttgtgtcattgatattattgataaacagagaacacaggttgacaaaagacaagagaggccaccagaaatccatgaagacagagcctcttctggagagagcaggctgttggccaccctgagacccctccccaacttgcgcctggcctggattttgcaggggacggggctggggagctggtgctggtgtagccaccggccctgacacccagccgcgtgaccttctctcgtggcctcacagtcctcccttcaagggtcccaggcctgcccctcgaggccctctgccctccaggagcgcccccatgtccttcccagcatgggcagtgccttacagacacaggaaggctaatgtcagtggagggacacagtgacaagaggaagaatgtgcagcgcccttcaggagcgtggtggggccccagcaggggaggaaggctccaagggggatgacagcatggctgtggcaacgacagttccatgatggcagtgggggtggcggtgggggtggctgacctaacacaggggaggtaactgtccaacaggagccaggctcagccaaggagtacagccaggaaacctccccttccctccccctgcacaccaccctggatgaactgaggggccacccaggcactggagcctctgctgctgtcacagagtcaggctttgggcatggagcagctggcagaggggtgggtgctgaagggcaagtggactccatggagagggccctgatacggggaggctctgctggtctccgggagcaggtcaggacctgagcagactctctgggctcctcaggagaccacccagggcacacccagccctgcaagggtctctacgtggtgccgtcagtgccctgcaccccctggtaggctgcccacacctgtacctgctgccccacccagcaaggctgcagagctgcgtggttcatgcccacctccaaggaccccatggggctgaaggagacagcagagctgcccagctgcaaggttgtcagaggacccctgtttttctgtatttctgacagtaggagatggtgccattgctggaagatgggcctttcaggctggcacccagccccgccccagggggccacgccacctcccacaggctcctgcatggtgggcatgtcccaagccagcctcatctggccaggttgtcactctgggtaaagtgaggtggcagccctgacctgccagcagcagacagtagaattctacagagcatccttcaggctccagggaaggacagagccctgagcagcaaagactccaggaggcattgtggctttggaagcttttcttcaaagcttccaagcccatgttcaggccactttgcacctgagtgacagcatttagctttctttgtgttaggagaaacccatggattgactttcttttcctatttcctccgggggtgaagtatcataagccaggaaaaagtgggtcagggactgtctaggtgaccctggagagcctcgccaggagctccaggggtccatcaagggcaatgggagcaggaggggtggtggccacttcttgatggtgaggggggtgatgaggctcccttaggccctgaaaaggtcagaatggggggtagggagccacctcctgcctggagcagttgatgctcagagctgctcccatgtgtcctcatccctccttccaggtaatggagccatgggtttctaggggaatccagggctctggggagactgggattctgactttgatctttgactgactttgatcagttctcgtgtttttcctgtgcattttctgatgagtttatatctgtcaggagcctcaggaccgtgctaagcccccaggatctgagggtaggaaaaaccatgccttggatttcctgcagacatttgaccatggtggaaggctcaatgaaacttccacctaaacttggcagattgaacacttcattgattttcactctctcccagaatcctatcaaatgatcattagtaaatagagaattccaaaccctacaaagaaaaatacaagcaaatgaacaatgaaatcagtcagagcctaggaggctgaagcacactctgtgggcctggagggcagatggtttcgaggaaacagccctcaatgccacagagggaactggaggagcaaagtgactgaacccccagagctggaacgcaggcccccagcccagcctgtgggaggtgcagcctcattcccaggaaagggtgagccagagaggccctgcttctgggcatatcaggtacgtcccaagaagagggaggcaccaggttggggacaggggagtgaacgtttgtctgggaagcaaagacacagcccctcccgttctccaggaggcagcagcccagataccagtggccagtcatgggctcctcagactggaagtgggaggacttttctcgagggaaactgaacaggcccagagaagagacagtgaaggggaacctttaattaagatgctggctcatccatcacatctccctaaagaaagcttccaatccattttttaaaaataagctttttgttttagaagagctttagatttacagaactatcgtgaagatagcacagagagttctgacacacaccaccccagctcccctgttactaacatcttacattagtaaggtgcatttgtcacaactaatgaaccatgttgatgtgttggtattaacgaaatagcatcttttattctgatgtttttagttttgacctagtccccttttccagttccaggacatcacatgacatttgctggtcatgtctcttgggctcctgatggctgtggctgtttctcagatgttccttgttttcggtgaccttgcgagttctaaagagtgctggccaggtgctttgtagaatgcccttttactgggatttggctgatgtctgataagatgaagatagtgtgtcttggggaggaagaccacagccaaagtgtcactctcatcatgtcacaccaagggtatctgctactaacataatttttcactgtttttttacattttagatccagggggtacatgtgcaggtttgttacgtggatatactgcataatgctgaggtttgggcttctactgaacccatcacccaaatagtgaacacagtacacaacagggagtttttcaactcttgtcccccctccccttttggagtccctagtgtctattgtttccatctttatatctgtgtatacccattgcttaactcccacatataagtgagaacatgtggtatttggctttctgttcctgtattaattcacttaagataatgacctgcatcctagctgcatccatgttgctgcaaaggatgtgattttactcctttttatggctgcatagtattccgtggtgcatatgaaccacattttctttatccagtccacagttagtgggcacatagattgattccacgtttgctactgggaatggtgctgtggcttatcactgtggatgctgaccttgaccccctggctggggcggtgcttgtcaggtgtctctgctacaattactcttccacactgcaccctttggaaggaagtcattaagcacaacttccacttcgggagtggggagtttcgctacctgaccttaagggtggggtatcaacataatttgtttggaattctcctgcacagaatatttgtctttcctcccccacattgatttatttattcagtaatttattgatgtcaatatggatatttattgtataacttgggttataatctgatactactttattttgttgctcaaactgttccagttttggctgttgggagctctttcagttgactcctgtgtctcttttgcatagtcctatcattgtgggttgattttttgtttgtttatttgttttatcatgttcttgctttctggtgctacaaagtgctctaggctcaacttcaatatttcttgccacattcctagaaacaaccattctccaaggatctctggtttctttcactagacaatggtattaaaaaccaagatatgggtgctggggatgctcatttctactgggggcattgttgcttctaggccctctcagtggacagagcaaggaaatctgtatggatgctcacccatgtgtgtatccatgtgatggttaattttgtatgtcagcttggctaggctatggtgccaagttttttggccaaacattagtctagctgttactgtgatagtattgtttataggaactaccctttacaacaccggtaggtctcatctcatccaatcatttgaaggccctaagagtaaagactgaagcttcctgaagaagcaattgtgcctccagactgcagcatagaaaccctgagtttccagcctgcaaatttcagactcaagactgaaacatccattcttgccttaacttccagcctgcaggcttgctctatgtatttcagatttaccaggtcccacaatcacatgataggagtcagatccttaaaaatttctgtgtgtctacatgcacacacacacacaattagttttgtttctctggagaactctagtataacacatatctatgtctctatctatatctacatatctatattaagctaaacgttagtccacatgatgtctccccctctaatctactatcgcatggatcattctccccttccagcacccttgcttcttctgtaacctcccactcaaacagcgagatgctggttcccaccatccaccagacacttatcaaattgtctgatccacatgtatagtggtttcagaattgttaacccatacttctgtggggaaaaactttgccaaaaataatacagtgcttacgtgcctttctgtttgtctttagtcttagaaaaatccgctaattcccaaaattacttaggtcagcaccgtttctcccaccctcttcaaatgagattatttcatacatttgtaatgcagttacattattttgtcacattctgcattccatcctgggatctccaacatcctacatgttaaaaatatacatgcatttgtgtcaagttctgtgtattttgacacacgtttaatatcttgtattcaccttcacaaaatcatacagaatagtttcaccaccttaagctatttcctgtgcttcacttgttcaatgccctactcccaatcccctggcacccgccaatctgtttaccatctctacagttttgcctttttcagaagatatcattggaatcacatggtatgcaattttttcaaactaacaatatacatttattaaagatttattcatttcttttcatggcttgatggttctttttttattgctgattaacattttattgcatggatataacatagttggtttatccattcccttgtgaaaggcattttggttgctttcagtttttgacaattgtgaataaaaccactataaacattcacgtagattttttgtggacgtaagttttcaatcagttggtaaatacctaggagtgtggttgctggattatatggtaatcctgtgtttaactttataataagctgccagactatcttccaaagtgactggcccactttgcattctcaacatcaatgaacgcgagctcctgttgctctctattctcaccagcattaggattgttcatttttagattttaggtattctaattggtgtgtattagtatctctttgttgttttaatttgcaatttcctaatgacaaatgatgatgaacatccttttatatgttattttatgatctgtatgtcttctttagtgaggtgtctgttcatatcatttgatgatttttaactgggtttttttcattgttaagttttaagagttgttttgtatattttgtatacaggcaatttatccgatagatgttctgcggaggttttcttctagtctgtggcttgttgttttattctcttaagtgtcttttaggaaagcagaattgtttaattaataaaagtccaacttaccaatttttttcttttttttccaacaacctcttgtccaacagaacctttttttttttgtcttttttttttccattttgtggagaacaggatctcactatgttgcccaggcaggtctcgaactcctgggctcaaactatcctcctgcctctgcctccctaagtgttgagattacaggcatgagccaccatgcctggccagaacctatttttaatggatatatttgccaatatttggatgagtatttttgaatctatattcatgagaatttctggtctgtggttttcttttcctgtaatgtttttatctgtttttttgaattagggtaatcatggcctcatagaatgagttaggaaatagtccctcttccattttatatcttaaatgtttggtagaattcactggttcttgtatttgtggaatgttattaattattgattcaatttctttaataggtataggcctattccaatgatctatttctgtttctgtaagtcttagcagcttgtgtctttcaaagcattggttcatttaataatgttatcaaatttgtggtcatagagttgtttatagtattcctttattatcatttaaatgtctatggaatcactagtgataactcctctttcatttctgatattggtaatttgtgtcttttctctaacctggcttttggcctacgaatttgattgatcttttctataaaagatagttttgtttttttcatcttttcaatttcattgatttatgttctatgttttattatttcatttttccctcttgattcatgcttaaattgtacctctttatctagtttcctaagttattaattttacatatttattattactgttttttttttgagacagagtctcactctgtcacccaggctggagtgcagtggcgcgatctcagctcactgcaacctccgcttcctaggtttaagcaattcttgtgccttagcctcctaaatagctgtgactacaggcatgcatcaccatgcccaggtaatttcttttgtatttttagcagagacagggttttgccatgttggccaggctggtctcaaacttctgacctcaaatgatctgcctgctttggcctcccaaagtgctgagattacatatgtgagccaccgtgcctagctttgaatttctaatatatgcatttaatgccataaatttcccctttaccactcctttcactgtatcccacaaattgtgataaattatagtttattttcctttagttcaaaatatttttaaatttctttttcctattattttattttattttattttattttattttatttttttagacagggtcttgctctgacactccacaggctggagtacagtggtgcgatcatagctcactgcagccttgacctcctgggctcaagcagtcctcctgtctcagcctcccaaagtactgggactacaggtgcatgccaccccacctggcttaaatttctcttgaaaattcttctttgactcggctgggtgcagtggctcatgcctgtaatcccagcactttgggaggccgaggtatgtggatcacgaggtcaggagatcaagatcatcctggtcaacatagtgaaaccccgtctctactaataatacaaaaattagctgggtgtggtggcacctgcctgtaatcccagctactcaggaggctgaggcaggagaatctattgaaccaaggagttggaggatgcagtgaaccgagattgcgccactgcactccagcctggtgacagagcgagactccatctcaaaaaaaaaaaagaaaaaagaaaattcatctttggctcatgtgttatttagaagtgtcttgtttaatttccatattaaatacttgggggatttcccagctatctttccattattgatttctactttatttcaactgtggtctgagaacatactttatacaatatctattcttttaaatttgttgaggtgtgttttatggccccagaatttgatgtatcttgttgaatattccatacaagcttgagaagaacctgtattttgctgttgttgcatagtcttctataaatgtcaattagatcaagctcattgaaattgctattcaggttaactttagcctttattttacacctgcttcatcaatcagctactgatagacaggtgctgaagtctccaactataatggtggatgtgcctatttttaagttctattaatttttgcacatatatttatttaggtgcatataagtttaatattgttatgtcttcttagagaattgagccaattatttttacatagtgctcttatttatccctcataagtttccttgttctgaaatctgctttgtctgaaattaatataactgctccagttttctttcaattagtgttagcatggcatattttctctatttctttgcttttaacccatcagagtcttaatatttaaagggggccgggcacagtggctcacacctgtaatcctagcactttgggaggctgagggaggcagatcacgaggtcaggagatcgagaccatcctggctaacatggtgaaaccctgtctctactaaaaatacaaaaaattagcgaggcgtggtggcaggtgcctgtagtcccagctactcaggaggctgaggcaggagaatggcatgaacctgggaggaggagtttgcagtgagctgagatcacgccactgcactccagcctccagcctgggcaacagagtgagactctgtctcaaaaaaaaaaaaaaaaaaatatatatatatatatatatatatttaaagggtttcttacagaaaacaaaaagctaggtgttcattctacttctttaatccactctgaaaatttctgtcttttaattgtgtgtttagatcagcagtacccaacctttttggcaccaggaactggttttgtggaagataatttttcaatggaccaagggttgagggagatggtttggggatgaaactgttccaccttagatcaccaggctttagttagattctcataaggagtgcacaacctagatcccttgcatttgtagttcacaataagcttcaaactcctataagaatctaatgccaccgctgacctgatagaaggtggagttcaggcagtaatgcttgctcacccgctgctcacctcctgctgtgcagcccagttcctaacaggccttggaccagtccacagcccagttcctatcaggaactgataggcctttgggaggtgattaggtcatgaaggtaggacttggtactgagaagtggagggggctgccataataaatacctaaaatgtggatgcagctttggagccaggtaatgggtagaggctggaagaattttaaggtacatgctagaaaaagcctacgttgctgtgagtggttcataagcggaaattctgaggaggaatctcaggagaagaggagtgctacagagacagactcaatcttctgagaatatctaagtggttatgagctgcatattggtagaaatacggacaataaaggccattctgatgagtttcagacagaaatgaggaacatgttattgttggacaatggaggagaggccattttatcataaagtagcaaagaatctggttgaattgtgctcatgccctcgtgttttgtggaaagtcgaacttgcaagcaatgaaactgggtatttggctgaggaaatcactaagcaaagtagtgaaaaggtaggctggttcctctcaattgcttaaagtaaaatgcaaaacgaagaaataatttaaaagatgaaattgtttgtcaaaaggggaagcagaacttaaagatttggaaaattctcagccaatccatattggaaataacaaaaaagcctgttcaagacaccttatgataaagagattactatggatcaggcatctcaccagaagcctcatgctatacatcaaaataatggggagattcatcagtcatctaaacagaaaacaggacctaaaatctaagacaatggatgaatacccgcaaagacatttcagagatcatcagggctgcccctcccatcacagggcttcaaaggagggaccaccactacccagcagcctcacactgcaggctgtgctctttgctctccatcaccacactctccagtcatcccatgtgtgctttggtgggccccattgcagcatgcactgcaccaagcaaagctgtggggggcagagccggatttcaaaggatgccctagagagcactggggcccaggcagagaaccaccacaggggcagggccactgcagagagctcccaactaggaaaatatccagagagcaatgagggcttgacctcagactggtagagccactaccatgcaattccaggcccaggagagcaacaggtccacaactccaacccataagagctgtggcatgggctgtacacagcaaagccatgggggtggggctgtccaaagccatgagggcagacaaagctgaggaggagagatcaccatcccagtaggtccagaaggctgtcttccaccccagtgggtggcatcaggtcaaggaatatttctcttgagccttaagagtttggacttgttgagacctctcatacctttctttattcttatttctcccttttgggatgggactgcctgtcctgtaactgtcccaccattgtattttggaagcaagtagcatgtttgattttaaatattcaatttggattgctggagaacaatgccttaaaatgaatcataccttgaatctcatccacatcctatttagatgacatttagataaaactttggtcttgagactttcgagttgatgctagaatgagttaagacttccaggtctgttgggatgagattaatgtatttcacacctaagaaggacatgaattttggaaggccagggtggaatgctgtggtttgcatatatattttgtatacagacaatttatcagatagacgtcttgaaaatattttatttcagtctgtttctccctcaaattcatatgttgaaatcctaacccctgaaatgatggtatttgggattggggtcttttggggtgattaggtcatgaaagtggagccctcatacatgggattaatccccctataaaagaggcctgagggagaccccctgtcccttccaccatgtgaggacatcacaagaaggcaccatctatgaaccaggaaagggttcttcacctgacaccaactctgctggcaacttgattttggacttcacagcctccaaaactgggagaaagaagtttatgttgtttataaactacataatctatggtattttgtcagcagccgaaatggactaagaaagcaggtctgctggtgataaagccccctagtttttatttttctgagaaagtctttgtctttcacttgaacaataagttcactggatatagaaatctaggttgttggaattttttttctgtcaacaccttaaatatttcaccctactactaactgggtgggtagagtgggttttaatctccgcaaaatgccccatcccagaggaattatcactatttgtgttgtctggtagttccctaaaaagctgcatgctcaaggcttgcctttatttgacctgactcagagctcactgtgtataaacagctctatacctaaggtgtttattgaaaaaatgagaaatttttctacactgtagctgcctgagataacaataagagctgtggctaacaaaggctaactaaaaacctttaaagtataaaccaaagataaaatcctaagcccccaactgactgaatgaaccccatcttggccaaagggaacacagagaaacctgaaaaactaaattccaggccatgacgggaagggaggttagatttgcctcgttatactcctgcctttttggagtttaggcacaggtgaccagcattaacattaaaactgagatcataagactgaccaaacagactctttgtggcaataagataccaaattgcaacccgactttggtatagtatcacatgacggatagcagactctgaaggaaataaaaatattttatcccaaaatatatttctttgacatattttgaaatggctgccacaagccagcagattgatgtagaggaaatttgcatctgaagagaatctccattaatgcagccaggccttccctttctaggcctttcctagatctaggagagaatgagagtctgacacctttaaaagtttaaaaagaaacatttactatctattctctctgagggctgccacctaagaggcttcatctacataataaaaaccttgttgttcacaacctccttatcttaactcaggcattcctttctgatttcaagcctttagacaacagcttaactctctcaaccaattgtcaactaaagaatccttaaaacccacctaggacttgcaagccctcactttgaaatgtcccggcttttcgggctgaaccaatgggtactttacatgtatttatttatgtctttactgtaacttctgcatccctaaaaggcataaaaccaaaatgaaacctgattgcctcaggcacacttctcagaacctcttgagactgttccctggaccagggtccctcatattagcccagaataaacctctttaaatattttacagaggttagtttatgttcatcaacaaaaggaaaaactgaaaaatgagatatccataatgggcttagaaaagtgatgacatattcctacaaatctaaacaccacatgcaagtgcagggctgtgtacatgctcaggaaaaaacctgataaagatctagtctctcacttatagcttaacttgaggttctgcatttgcaggaagtgaaagttaaggcagatgtataaactgcaggcctgaacattgacagtgtgctccaacatatacacagagttcccagcaaagactgggagactcattggtccaagacattcaaggaaatttctgtccaatcattagctgaccactataccaactaagaagagacttcggtggctgcacataaccaagaatacagactttacagaattaacccaggaaatccaccaaacaaacaagcagaagcaacaataacaacaacaataaacaaacaaaaaagcttggttaggaaggggaatcttattttccatgtcgccacattatattatttaatatattcagttttcaacaagaaaacataggagataggcaaagaaacaggaaagtatggcccatacacaggaaaaaagtcagtcaatagaactgttcctaaggaagagcagatgagatgttggacttactagacaaagactttacatcagctattgtaaatatgtgcaaagaactaatgaaaatcttgtataaataattaaaagaaagtatgacaacgacatctcaccaagtagatatataaataaaaacatagaaactacaataaaaacaaatagaaattctagaattgaaaagtacataattaaaattaaaaatcactggaggggctcaacacaagattttcacttacataaaacagcatcagtgaaccggaaaatagatgaaataaaatgatacatttgtagaataggacaaaaaattaatgaaataaatgaacagaagcctcagaaatctgtggaacaacatcaagtgtgccaacatacagacaatgtgagttaaggaggataggagagagaaggggtcagagagaatatatggagaaataatggctgaaaatgtgccaaattttatgaaaacattaatctatgtatctaagaagcttaatgaactcctagtaggataaactgaaagtgatccacacctagatccttcataatcaaattgtcaaagtgacaaagacaagaagagccttgaaagtagcaagagaggctagacacagtggctcacgcctataatctcagcactttgggaggctgaggcaggaggattacttgagcccagaagttggagaccagcctaggcaacataatgagtctccgtctctacaaaaattagccaggtgtggtggtacatgcctgtgagccctgctatcaggaggctgatatgggggaatcgcttaagcccaggagattgaggctgcagtgagccattatcatgccaccgcactctagcctgggcaacagagcaagaccctgtctcagaaaaaagaagaaagtagcaagagacaagcaactcatcacgtgcaagggattctcaacaggattaatagctgagttctcatcaaatatcatgggagccagaaagcagtggaatgacatattcaaagtgctaaaaaaaatgacttttaactaagaattctatatttggccaaactgtttttcaaaaagagcaagaaattaagacattcctggataaacaaaaattggcagaattcattattagcagattttcacataatggctcaaacaaatactaatgggagtgctttagctgaaatgaaaggacaccggacaataactagattcacataaggaaataaaagtcaccaattaaggtatctacaatgtaaataaaaatgacaatttgttttgtgacacttttcttctcctatctgatttaaaagacaactacacaaagcaataattgtgttgatgagtttaaaatgtataaagatgtaatgtcatgacaatggcaaaaagaagagataaggaatagatttatattgaagcaaagttctttgtatagtattgaaataaaattcatattaatatcaactatactgttttaattaatatgttattgtagccctcagaggcccactaagaaaataaccatatatatatatatatatatatatatatatatatatatatatatataaaacagacataaatccatttttcccaggaattacattaaatgaattaaacactccaaccaaaagtcagagattggcagaatggatttgaagagtgtgattcaactatacttcaacaagacacatacttcagattccaatacacaaataggttgaaatgaaaggacggaaaggatatgccatgcatacggtaaacaaaacagagctggtgtggctacaccaatatacaagataggccttaaggcaaaaattgttactagagacaaagaaatacttgtataatgataaaagagtctacctattagaaagacataaccaaagtggttatgtcttgccatctaacaacagagctactagatatatgaagataaaagtgaaagaaaggaggaagaaatagttcaacataatagcaggagacttaaatactcaactttcaataatggatagaacaactacacagaagaccaacaggggacccaaagacttgaacaacactctaaaccattagacataacaaacgtctatagcacactccaccgtaccacagcagaatacatattcttctcaagtgtacataggacattctctaggatagatcatatattagataaaaaaataaatctcaataaaattttaaagattaaactcatataaagtatcttctctgaccacaatagaactagaaattaataacagaaggaaaactggaaaattcacaaatatgtggaaaataaacaatgcacttctaaaaacaaccaaggggtcaaagaacaaatcaagagaaaaattagcaaatactttgcaatgaatgaaaatgagaaagtatgtgatatggtttggctgtgtctccattcaaatctcaacttcaattgtatctcccaaaattcccacatgttgtgggagggacccagggggaggtaattgaataacgggggctggtctttcctgtgctattcttgtgatagttaataagtctcacgagatctgatggttttatcagggtttacccttttgcttcctctgcattctctttcctgctgccgccgtgtaagaagtgccttttgccctctgccatgactatgagacctctccagccatagagaactgtaactcaaattaaacttcctttttttctcagtcttgggtatgtctttatcagcagcatgaaaacagactaatacagtacaaaaacaaaaaattgtttcatttaaaagataatcagaattgcaaacctttagctagactgaccaagaaaaaagaagattcaaattactaaaatcagaaatgaaagagacataaacatgcatatatctttatattattataaagaattatttatatattatcctaaattattacttatattcctttaggtatatacccagtaataggattgctgggtcaaatggtatttctggttctaggtcgttgaggaatcttccacaatggttgaactaatttacattcccaccaacagtgtaaaagcattcctatttctccacagccttgccagcatctgttgtttcttgactttttaataatcaccattctgactggtgtgagatggtatcccactgtggttttgatttgcatttctgtaatgatcagtgatgtagagctttttttcatatatttgttggctgaataaatgtcttcttttgagaagtgtctgttcatgtccttcacccactttttaatgagagtgttcattttttcttgtaaatttgtttaagttccttgtagattctggatattagacctttgtcagatagatagattgcaaaaattttctcccattctgtagggtgtctgttcattctgatgatagtttcttttgctgttagttcctctttcttttagatcccatttgtcaatttttgcttttgttgcaatttcttttgacattttcatcatgaaatctttgctcatacctatgtcttgaatgggcctagattttcttctagggtttttatagttttgagttttacatttaagtctttaggccatcttgagttaatttttgtataaggtgtaaagaagggctccagtctcaattttctgcatatggccagccagttttcccagaaccatttattaaatagggaatccttttcccattgcttgtttttgtcaggtttatcaaggatcagatggttgtagatgtgcagtcttatttctgaggtctctattctgttccattgggctatgtgtctgtttttgtaccagtaccatgctgtttttggttactgtagccttatagtatagtttcaagttgggtagcataatgcctccatgttcattctttttgcttaggattgtcttggctatacgggctcttttttggtcccatatgaattttaaagtagtttttttctaattctgtgaagaatgtcaatggtagtttaatgggaatagcattgaatctataaattattttgggcactatggccattttaacaatattgattcttcctatccatgagcatggaatgcttttccatttgtgtcctctctgatttccttaaggggtggtttgtagttttccttgaagaggtccttcacttcccttgttagctgtattcctaggtattttattctctttgtagcaattgtgaatgtgagttcattcactatttgactctgcttgtttattgttggtatataggaatgcttgttatttttgcatgtttattttgctgaaggtactttttgttgctgaagctacttagcttaagaagctttgggctgagacaatgggattttctagatatgggatcatgtcaactgcaaacagacccagtttgacttcctctcttcctacttgaatacctttatttctttatcttgcctgattaccctggccagaacttccaatactgtgttgaatggaaatggtgagagagggcatccttgacttgtgccagttttcaagggaatgcttccagcttttgcccattcagtatgatactggctgtgggtttgtcataaatggctcttattattttgaggtatgtcccatcaatacctagttcattgagagtttttaacatgaagcgatgttgaattttatcgaagccctttcccacagataaccatgtggtttttatctttagttctgcttatgtgatgaattatgtttattgatttgcatatattgaactagccttgaatcccggggatgaagctgacttgattgttgttgataagctttttgatgtgctgctggattcagtttgccagtattttattgaggatttttgcttcaatgttcattggagacaatatgttttataaaatagacataaaaatactagcaaaccaaatcaagcaatgtataaaaaggattatatatcataagcaagtggatttatccaggaataaaagattggcataacatccaaatataatcagtgtgaaacaatatttttttttgtaatagacaaaaaaagcatctgataaaatacaacacctttttctgttaaaaaaaaaaaaaaaactcaacaaacttaaaatagaagagaatttccttaaccttctacagggcatccgtgaaaaacccaaagctaacaccataacgtggtaaaagactgaatactttcccactaagataaggaataagacaaagatgtctgctttcaccacttctatttaacactatactggaggttctagccagggaactattaaaaggcatgcagactggaaaggcagaagtaaaactatctctacagatgacataatcttgtatacagaacatcctaaggaatccacaggaaaattattagagctaatacatgcattcaacaaggttgtgggatacaaaatcattagagaaaaattcatagtatttcaatactttgaatgaacaatttgaaaatgaaattaaaggccagccacagtggcttgtgcctgcaatcctagcactttgagaggccagagcaggaggatcgcttgagcccacgagttcaacaccagcctgggtaacatagggagactccgtcttctctacaaaaaaaaaaaaaaaaaaaaaaaaaaagccgggcatggtggtgcatgtctgtggtcccagctattcgggaggctgacatgggagcatcgcttaagcccaggagatcaagactacagtgagctgtgatcacaccactgcattgcagcctgggcaacagagtgaaactctgtcaaaataaaggaaagagaaagggaaagggaaagggaggaaaaggaaggaaggaaggggaggggaggggaggggagggagggagggaggtaggaaggaaggaaggaaggaaggaaggaaggaaggaaggaaggaaggaaggaaaaagaaaagaaaaagaaaaaattccatttacaatagtattaaaattttaacaaataatttgcaagacttgttcactgaaaactacaaagcatttctggaaggaattagagagcatctaaataaagtaaggcatcccgtatttatgacttggaagatttaatgtttctaagatgacaatactctctaaattaatctacagatttgatatcctaaaaaataaaaccagatttttgtttttcatttttataatttgtttgtttttacttttttgctgatctgatgttaaaattcatatgaaaatacaggagattcagaatagctaaaacaatcttgaacaaaaagaacaaacttagagaactcgtatttcttgatttcaaaacttaccacatttggttatatttggtacaataatcaaaacactgtggtactggcatgaggataagtcaatagttcaatagaatagaattgagagcacagaaataagtgcttacatttatagtcaataagttttctacaagggtgccaagatgattcaatgaggaaaaaaaagtaacattttagatctttccctcacatcaaccatatacaaaaattaactcaaaatggatcacgaacttaaatgtaagtgctaaaactacaaaactctttttttttttttctgagatggagtttcattcttgttgcccagctggagtgcaatgacacgatctcggctcaccacaacctccgcctcccaggtacaagtgattctccagcctcagcttcctgagtagctgggattacagacacgtgccactacgccctgctaatcttttttgtatttttagtagagacagggtttctccatgttggtcaggctggtcttgaactcccgacctcaggtgatccacctgccttggctccccaaagtgctgggattataggagtgagccactgcacctggcctataaaactcttttttaaaaaacacgggagtaaatcttcataatcttgaattaggcactggtggctttttggtttttttgttttttgttttttgttattttttgataaagtctttctctgttgcccaggctggagtgcagtggcgcaatcttggctcactgcaacctccacctaccgtcccgagtagctgaaattacaggcccgtgccagcacactcgggtaatttttgtatttttagtagagacggggtttcaccattttggccaggctggtctcaaactcctgacctcaagccatccaccagcctcagcctcccaaagtgctgggattacaggcatgagttactgcacccagcgttgaattaggcaatggtttcttaaatatgacatctaaggcaaaagtgacaaaaggaaaaataattgataattggattttctcatttcctcaaaattaaattttcagggggttcaaaggacaccatcaaaaaagtgaaaagacaaccccacaggatggggacaatatttgcaagtcatatatctgataaagaactctcaaaactcaatagtaaaaagataatccaatttagaaatgggcaaaggactcattttttcaaagaaatttttccaaaatttttccaaagaagatatacacgataagcatgtgaaaagatgctcaccatcatttgtcaccagggaaatgcaaagctaaagcataggagatactgctgcccattcacgaagatggctagaatcaaaagcagccaacaacaaggcttggcaaaggtgtggagggatccgaatcctctcacggtgggaatggatgatggggccactgctttggagaagagcatggcatttcctcagaaggttagcgtaggtgccacgtgatccaccaattccaatcctaggtatcgtttttgtttgtttttttgggatggagtcttactctgtcacccaggctgaagtgctggagtgctggagtgcggtagaatgatctcagctcactgcaactgcaacctccgcctcccaggttcaagcgattctcctgcctcagcctcccaagtagctgggactacaggcatatgccaccacgcccagctactttttgtatttttagtagagacagggtttcaccatgttagtcaggctggtctcgaacccctgacctcagataatctgcttgcctcagccttcctaagttctgggattacaggtgtgagccaccaagccccaccctaggtatctattcatatctaagagagctgaaatatatttctacataaacacttgtccatggatgttcatcagcagcactgcttacaatcacccaaaagtggaaactgcccagtgtccatcagctgagggcatttatctgaggggagttttcgggaggcgggaggtgagaccgcatgggaggaaagctcagggcctggagtgcattcagcagtggctgggaagactgcctcagggcctgtgtgctccctgctgcactcacaccccttgctccatggagaactgagatgaaaccttgaagattccaaatgcagttgatggaaatggcagttgctgtggttattatctagggagtgcctgtgagaatctaacaagaaaacacacttagagagccccaccagcctcgcggaacaggaagcctgcgttctgtgtttccagttccctcattgccctgtcctgtcctgccctccttcccactcactggctacacataatcaccactggtatcacaggaggtcttggatctgtgtgtgtgagagagacagacagacatagacagacagacagagtcagtgggagccagagagagaaagcatgggagctaatttctccctggctcccaatgaggaatgaggacaggaaaagtcatgcagcatccaggctccttggcgcaactgggtcccaattcccatcctcctgccatcagcctcggtctgtccccaccttgccactgcccccgaattaaatgcttccgagcattttctggaactgtttttctcacatcgcccacacattcttattcccttagtcgaggctctgtccaccttcagcccaccggacagtcaattttcccagccgctggtgagtttctggtttgccaagacccagaggctgggggaagccagacagcaggtggcagctcttccggccgaggagaggagagggacagggctggctcctctagatgaagaggtgagagagctgtgctaggatcaggcggacagtgttcctggcagtagcagcagcaagagcacaggccctgaggtggggctgagctgacctaccccaagagtgaatggcaacccctcaggggccttagagagtgagaaggggtggagagaagtggaggagggtcgccaggggccaggtcatgccaggcctcatggggtctggtggcagcttccagctctattttggttgcaggttttaatcccaaaagttgtgttccctggtcacacttgagaaacgtgggcagctgctatgttgaatggaggttgaaaagaaggggcattaggggggtttgctgtggttgaagtggggatgaccacatgggctaggcgttggagggggcaggctggagagacgcgggaagactgggtgcatgaaatgatgtcccctgcccaggactcgctgaggccacggcaagtgcatgaggaagcacagagtccagggacttctggtctccagcctgagcaggaggtagacaggatgtgaatcccagtgtggggatggatggggcccagtggaacccttgccaggtgggccctgaagctcagggccctctcaggaatcattttatgtacatcatggtgcaggcagggtagtgctgtcctggggcaatgtgaatccattatttattgtggcacagcagtattgtcattttcttgtttgtttgcttagttattgtttatccttgaaatagaattaatggcttgctgaagtatcctttgtgcctagaacaatgctggcacagggcaggggctcaactgatatttattgcatggatggataaatggatgaatggatggatgatggattattggtggatagatggtgtattagtcagggttctctagagggacagaactaatatatataaaggggagtttattaagtattaactcacatgatcacaaggtcccacaataggctgtctgcaagctaaggagtaaggagagccagtccaagtcccaaaactgaaaaaaattggagtctgatgttcaagggcaggaagcatccagcatgggagaaagatgtagtctgggagactagacctttctcctcttttcacacttttctggcagcttttcatattctagccatgctggcaactgatcagatggtacccaaccagattaagggtgggtctgcctttcccagcccactgacccaaatgttaatctcctttggcaacaccctcacagacacacccaggatcaatactttggatccttcaatccaatcaagttgacactcagtattaaccatcacagacggattgatggatgaatggatgaatggataaatggatggatgatggatgggtggatgggtggatggatggatggatgaatgaatagacatggaagaaaaggaaaatagatgcacagatggacagatggataaatacaaaaatagatggacagatggatgatggatggatggttggtgttaaggacttaattgtgtccccccaaattcatactgaagcactaatacctaatgtggctgtatttggagatagagcttttaggaaggcaattaaggttaaaggaggtcctaagggtagggccctgattcaatgggactggtgtccttacaagaagaggaagagacactagagagctctctctccatgtgtgcacagaggaaaggccccgtgaggacacaaggagaggagcctcctacaagctggcaagagaggcctcaccagaaaccagccctgctggcaccttgaccttggattgagtgtgagaaactcaatgtatattgtttaagccacccagtctgtaatattttgtgatgatggcctgacatggatgatatggatggatggagggatggacggctcccccagcccctctgagtcttccctctgggtgcaggcaaccctattcagggacaatgtgagtgcatggctgctgctggaaagaccagtcttgggaactggggttatgtttgacttcctggctcttcagcttgatgctctctagtcccaatctgggacagggctcctttcccacaatgttcaagtttgcagagggaccctggaaaccctgaaggcaatgccttggggccctcacacctggacccattcacacatttccaggtattggtgcctcccccgggagcctgcccagagcccttgcggaggacctggggcaagggaacagggcgggaagctggggcaagggaacagggcaggaagctgagagccgttttcctccgagctaatggaacctcttccatcaccaccagcttagcctttaatcatcctcactttcaagtggaaggcagagctccccagacactggacgggtcagggccatcatcttccaactaggggtgcacagcagggctaatggacgggactggggccaacagctggaaatcaaatcatctcccagaaccacagctcagcagaccctgggggaggggcacctccactctctgcgtagctcttgggtgcaggctggcaaggctggggaacagtcctgaactgctccacccaggcgttaccccctgcacacttcttggcctcaaaactttcgttatatggaagcttgatgagtaaaagttggtctggttgacagcaggtaagggctttctccctttctgccaggctgaccctgggaagacaccaaatggcatattggaatggtccgcttccaccctccccaacctgcctacagtgaccatagctgtgggcggccaccatcctgcccagaccacactgacgacgcttctcacagcctcccctctgacccctcctcctccacctgcccctggcacctgctgtggccctgccaccactcccactgcagtcccagcagaatgaagaggcttgttcaatgtgtggtttcaaggagtgaagtgcaaagcttcccctttcctttgcagtctctcttgatgtgttgtggtggttatgtttgctatttaatggcattctagtcaagaaaagttgaaattataaattatagaaaaaaattaaaattttaattttaatggtaaaataaaatttaccattcatctttatatcattcaatgccaattttaaacataaattgctgtgtaagagcatttaactcatgcagaaacaccaaaatttctgtaactcgtacatgcatgtatatgttgtccttttcagaaaagcgcaaacacttcactgaactaactcacctgattgaatttcacttcctggtgcaggcgcattgtaccaaccctctctacttcagcctaccaggagggaggaaggccaccgtctttccttctccttccatgtcatcctcagcgtcggtgcttgtgcagtacaggtaggtgacagagccggcaaggatgcccagggctgctcctctgtgtttcttaggagcccgctgccccaccgtgctcaggcagggcagcacgtgttggccacgctcaccagctggctgagctccacccggaaccctgtgctggggccttgggaggcctgatggggatgggctcacactcatccacacatcccttctgctcagagggcccagggcttcatttagcacaagttcagacatgaaaccgttaagaattccagcgtagccgcagcccagcactgaacccaatgcctgctcctctgactgtctaccttggctggttcctgtgtcactggaaggaggaaggaacccctcccccgtcaccacggttgttctgttttggggcctggcaccatcacccaacaactatttgctgaataaacgcattgttcacccactgagtatttgctgagcacctactggcagggcgccctgagggcgcagagatacagctgaggacagcgcagcttctaaccttgccatccccaaggtgcgcggagccctcagggtgacccagcttgctgacgagcaagcggaggccgagcaggtgagactggctgagtcagacctgctgccggggcagacgcaggacaaggctgcttttttgcccctggacctcaggatccaggtccgggacgccgcgggcaggggctctggaccgcgctactcgacccctcccccaccgcctgggtctgccaggcaggagggagccgctgcagccaacctgctcctcccgcactatcgattttcaattgacctccgcctcccactttacacttcagagcgctcagcggcctccacacctcctgagcaaggaggaaagccagctgggcgcggggcccctgcttcctccccgagggagtcctcggccaggccaccaccaccaatctcgctcctctccctttcctctctgtaaatgacacgaatggcattgtaaggactataacaggcacttggcctttctaactttttatttgaaaataacatcacacctacagaggagttgcaagaacaggacaatggattcccgtgggccctgtacttaggttcgcccattgttaacaagacaaggactttctctttcgggacacagcatcataatcaaaatcaggaaatttaaccatgatgcagtactcttttctaatattcagtccatattcaaatttcatcattgtcccaaccccgtgtgtccttcagagctcttatttttccctaatgcaggatccgactccagatcacacatctcatttccttatactgtctcttcattcagaacagttcagagagtcatagcatatgattctgacaggcgcagtgccctgctgtcatgctccccacacgcgtgcctgttcatgcacatacaacacatgcacgcgtgcatgtgcacacatacatatgcatacatatgtgcacacacatgtccatacacatccagcctacagcgggcactcgaggtcccctgccatcctccagtacctccccagccctgtggccatcaccttctctgcacacagcaccccaccaagctgccacaatgcctgtgttgggctttctctgagtggcctccctctgggtcagggcccagtcccctgggccaaattatgcccatccaggctggccttgtgcccagctggcttgtcctggccaaacctgctccaggggcacctctagagctgaggcccgggcctgagggcagtcccccagacctatcgggaggcatgtgaagctgccagcacagcaggaaagtggctgagctcagtgactctgggactctccgtgtgacctcaggcagtttctctgctctgtaagccacaactctctctatctggaaaatgggaagaacattattatatgaacactaaatgctcagaaagcccttccttcctggaatgggttagtggtacagcactgccctatcccttcttcccttttgagaagcacagaaccctatgggtgctgtccccagggcactcaggcccccactgctccttggtgccatctgaggccaggaatcagctcaggctctggcaaaaggattcttgtttttcgttcaagcgccacctcttcctctgcagacactcctctgcagtcctgcatgtactgcacgcatgcacacatgcatgtgcagtggtcccagaaggcagccccaaatctacaggctccacaaccccagggctcagagcctggcctagcacagagcgactcacaggccacctggggccatggaaggccaggacctggcaccctccttggcagcagaaaggacagagaaggtgccagttggaggcatggcccgacacagcgacactgcctagttcaagtcacaggccctgcaggaagagtgcagggcttggatccactcatagtgctgttccaatgacctgtggggtctgagtgccccagaagtctcaaacaccaatgcttgggtctatacattcagacaagccagactccatgggtctgacccccaggcagcctcccgtgccaccttcccctggatcaggcgcaccatccacaccttgtctggcttcactcaggcctttctcagtgctaacccacgtggctgttggtttgctgcttaggtgtgtgagacagtaacatgcatcttctcccagagctcacagcctgctggctttatctggtagcacatctgctagtgctccactgacctgtctatttttcctacctcattagggcaactttgtttttctgaaggtgattatgactacttactgaacttgaatatactaacagatacttctcaagtatacgtctgaagacgctgctctgagatgcacaggagtgtagatgagacgctgtctgagatcagagtttacttcttgcaaggccatcagaggagaggacgtcatggaggatgtggtcatgggtagtgcctctggctccggacaggcacagtgtgcagaggaccttgcaggagcatgggtatgaagggaataatgagcgagggtaagccaagaaatgttctagggggcagagccagccaggggccaagccaggacagttggatgcagctagacccagcagggcctccgcccgggttggactctggtagcatccactgcagtctccatccagccacgtgctggggtcacaaggcatgaacatgatctcacgatgaaagctgtctgtctgtgactgtgggagtgattgcattcccatcctttcaagctttccccagcaggagtggcaacgctgagcctcactccctggggcctactgtgacagacgccatggccagctcctcagggtggaggtgagggtgagggatgcagaccccacaaagttcaacccagcctactcttcactgcagctctgacttgcagatgtcaatgggctccttggaattcttcaaattcagagtcacagcccatttgagggggcagcctgaagctggttcgctggaacctttttctgtccacgttgagtgcttgctagaagctatgagagcagctccttctcactgttgtgatggcacaaaccacagccttaacccctgtgtccgcctaggctggagttgggctccttgacccctccctctccctcacactccatacaattaagccccattcactttactcccataatccctctaatgagcaggctcttcacccacctcctgccccctcactgtgctgcccagtttaggccctcatgagccctcacattgattccctgcctccagtctcaccctctgcaatttcctcccaacttaagtgcaaaacagaagtggcatcatggcaatcttcagtctgaaatatctaatgggcattcaggtaacagaatacttgagcatgggcatccaactgcctctcccaaatgctagcccaaatgacttcagaaatagaaaaggaaggagaaacctgtatccattttggaaatccatcagggcaccatttacacgccacacgcagagccatttccataagttacagtgcaggcaaaaaacagcctgaaggaaacttgcaaccctccttgctgagcaagtacaggcatgggggaagaaactgcaggggcctgagaaaggcccaggaataacccagctatagaggatggtgcagatgatgagggcatgacatatggaacctcttagcactgagggtcagcatgtctcaaaagcagaccagggcaggggggccagggcaatacttttcctgaggggtgcgcagtagtccaggaaacaggctagacagacaagggatggaccagtccaagtagaaaattaataagaaaaataggttcaaggaagaaattcccctgtacagagaaaaaacaccctgttggaactgaccagaaccatctcctccatcttgggctctgagttgattgtgaggcccttaggcccttagcagaggattctgttgttatttgtgtggacagcaaggagaagcaatgatgtaaagaaatgccatacttgtttgaggcaaatgccagtctttcatagagaccttgcaattcaatgctaggtcaatggaaacagcagatatgagaaagagaaaggctttgcaaagaaaaataaaaacacacacttctcaaaagatagatgaagagtgatgaaaatgatttaccaaaggaaacagaaattgtcttagtccatttgtgctgttataacaacatcatggcctgggtaatttataaagaacagaattttttcacagttctggaggctgggaagtccaagctcaaggcatcagcaggtttggctgtctggtaagggctgttctctgcttctaagatggcttcttgagtgctgtgtcttcacatggcagaaggccgaagagcaaaaagggtgaaatccttccatcaagctctttttttttatttttaagttttataggtacataataggtgtatatacatagtagctatatatatttatgggttcaatgagatattttgatataggcatgcaatatgtaataatcatatcaaggggtaaatagagtatccatcacctcaagcatttatcctttgtgttttaaacaatccaattatactattttggtctgtcaagccctcttataagagcatttaatcccactcatgagggcagagcccttatgactgaatcacctcccaatactatggcattggggatttaattttaatatgaattgtggagaggacacaatcatttaaaccacagcagaaataaatctcagaaaccatccatttgacgttcccaataaaatataaatttaaaaatagctcttaggagtagtgacattgccaaaacggcagagtaggaagctccaagccttcattcccccatagaaacaccaaaaaacagccagaaactgggtatttaaaactttataggcactttggagagcagaaaaaggtccacaatagccatattcacaagagtaggaagttttctggcatttttacacactcttgcctcactcccttcttggcacagcacagccttggtctgcaggaggccacagcccaattctcagtttcctccatcaaactggagggagcagaacggatcttagttgcgatgttctttttttttttttttttttttttgaaacagagtctctctctgtagcccaggctggagtgcagtggtgcaatctcggctcacggcaagctccacctcccaggttcacgccatcctcctgcctcagcctcccgagtagttgggactacaggcgcccgccaccatgcccagctaattttttttttttgtatttttagtagagatggggtttcaccgtgttagccaggatggtctcaatgtcctgacgttgtgatccgcctgctttggccttccaaagtgctgggattacaggcatgagccgccacgcccggcctagttgcaatgttctaacctgtgtaggggctgcctgaagaactgctctcttccatgcctaaatcacatctcaggcagggaaaagtggcaaaactcaggactcaagcagggaaaaaacaatgggcattgcccataaaggtttcatggggactacagacccatagacacctggggtaaaagattacaggtggagacatacaatagaacatctaaggtcccaaggaaaactagggtgagactctttggaaaattaagacattcaaaagccactgtgtatatagacaaaattgggggtgggggtgcagaagcacacacacaggcacaggcaagatgcatgcttaaaaaatacctgagaaactttcacatctggctgatcttaagtctcagagcacacccagcaaagcaggaaatgattgccctggtaaagagtcagtctgaaaagacagaaagaggtgactgctttccaaatgcccaattttcaacaataaaaaattataaggcatacaaagaaacaagaaaacatagctcattcgaaggaacaaaataaaatggcagaaactgtctctgaagaaacatgggcattgcacatactagacaaataattcaaaacaattctataaatatcctcaaagagctaaagaaaacacagataaagaaatgaaaagaatccagaaatttatatagaatcaaaatgataatattaacaaaaagatagaaatgataaagaaccaaacagaaattctagagctgaaaaatgcaataatgaattggaaaattcactagaggggttcaacagcaaacttaaacaggtagggacttgaagacaggtcacttaacactagtctgaggagcaaaaaggaaaaagaacgaagaaaagtaaacagagcctaagagatttataggacaccataaagccaaccaatatatgcataataggagtctcagaatgaggagagagggaaaagggtaaaagagtttacttgaaaaagtaacagccaaaaacttgccaaacttttatatccaaagaaattgatataaaaatacaagaagttcaacaaattccattaggataagcccaaacaagcccacagaaagacacactataatcaagccacattataatcaaacctttgaaagacaatgtcaaagggatagtcttgaaagcatcaagagaaaagtgactcaccaaatacaagagagccacagtaagattagcaatgattttcctagaagaagccctgcagaccagaaagcaatgcagtgatatatttaaagtgctgaaagaaagaaaaagctgtcaactgaacattctatacctagcacaactgtccttttaaaatgaggaagaaattaagatattctcagataaacaaaagctgagggagctcgttaccactagacttaccctacaaaaaatattaaaaggaattatttaagttgaaattaaaggatgctaaatagtaactcaaagccatacaaaaatataaagttatgcaataaagctaaatacatagacaaatataaaaaccagtattattatcattttggtttgtaatgccacattttattattttatagagtttataagacaaaggcatataaaataattatggatctatgttaatgggaacatatataaagatgtaatttgcgacatacctcaataacataaaatgggaagagccagaaggttgtagagcttttatattcaattgaagttcatttgttatcagtttaaagtagattgtaataactttaggagttttatgtaattcacatagtaatagtaaagaaaatatctatggaatacatacaaaaaaaatgagaaggcagccctgatgtatggcacatatatatttataattgttatatctttttgttgaattgacccttctatcattacgtaatgcccatctttgtctcttgtaacagttataagcttaaagtatatcttatctgacattaatataatcacgcttgctccttttagttaatatttgcatgcaattttttcccattattttactgtcaacctgcacacatgtcctgtgcccttaaatctagtgcattgtagacagtatacagttggatcatagtttttcttttaatccattctgccattctaggtcttttaatgggggaagttaatacatttacatttaattaatgtaattaataataaagaaggacttactattgctgtttagtagtttgttttctgtatgtcttatagcttttttgtccttcatttcctcccttcctgccttcctttgtgcatagctgactttttgtattgacatcttttgaataccttcttatttccttctatatgtattctatagatattttatttgtggttactatgcccaacaccactaatcattaggaaaatgcaaatcaaaaaccacagtgagatactatctcatactcattaggttggctactatttaaaaagcaaaaatgaaaataaaaaatgttgtcaagaatttggattgggatgtaaaatggtacagctgctgtagaaaacaatatagcaattccccccaccttctccaagaattaccatatgatccagcaattctgcttctgggtatatactcaaaagaattaaaagcaaggacttcatcaggtttttatacacctatactcatatcagtgttattcccaataatcaaaaggtgaaagcaaccgtagggttcactaatagatgaatggatacacgaagtgtggtatatctgtatgatggaatattattcagccttaaaaaagaagtaaattatgatacatgccacaacaaggataaaacttgaagacattatgctaagtgaaataagcaagacacaaaaagacaaatatcgcacaattccatttacatgaggtgcctagagtagtcaaatccacagagagaaaatagaatggtggtcgccaggggctggcaggggggagaatgaggagttgttgtttaatgagtatagagtatcagtttgggaagatgaaaatattcagagctgaatgatggtgatggttgtacaacaatatgaataatgtacttaatgccattgaactgtacacttacaaatagtcaaaatggttattttatgttatgtgtatttaccacaattttttaaacagcttttgaagtaaaagataaaaatgaattagatgactgactcggatgaggaaaccagctgagctaaggaaaagatgaaacgactgtaatgaaacaaaaagacttttctctgctgaataccaaggggcttagggaaggcacagctcctccttaggtgaggagtagaatgagcaaggagcagagatgtatcactggggatctgcacccaaggaggcaggtcacacagttgaggttcacactttggaaaggatgcaaccactgaggttacatggaaagaaaggagagacaaaaggctgaaattaacctggaacaaaagtagcaaaatgaagctcagaataatgagttattggaggaaatggaaactaaatccataaggagatgccgctactagtcactactagtcatttagccatacaacagctaaaactaaaaacggtgacaatgccaagtgttaacagggatgtggagcagctgggactctcagacagtgccagtggaagtgtaagttggtacaactataacagaaacccagttgacaggatctactaaagctgaatatattcacccctataatccagcaatttcacttctaagtatttacacaagaaaagtgaaaatttatgatcaaacagccttgtacgtgaatattcatagcagctttagtcataatagcaaaaaaactgaaatgaatccagaagtatcacaacaggagaatggagaaacaaactgtgatatgcccacccaacagaatactgcttagcaatagaaagaaccaaggtgctaacccacacaagaaggacgaagctcagaaacatgatgttgggcaaacgaagccagccaattatctgacattctagaagagtcaaaactacagtaacaggaagcagatcagtggttgcctagggatggggcgggaggcttgactgcaaaggagtacaaagcaactttcttgggtgctggaaatattccagatcttgatggcagtggttacacgggtatagacatttgccaaaatgcatcaaactgtccacttaaaaagggtgcattttattatacaaattatataatacagttgttgttttaagtgaaggatttgaactttatatccaggacagatgagagtgggaatgagacatggattggggacagagagaagtataagaaagcaaggaactcacaggaactatagagggctctgggttgggatctgggtccagcttatcagctctctagaggcaaggaggtccagtcaacacatgggatatgtcaggaaggctacatcagagttcaatactaagctgcaagcagtgaagtgcagaatcagtacttaagaaaaacaatgtgggatgtggaacatttgcacaggaaaaggtttcaagacataaaagccatgcaagagaaaaggagagctgtgcaagagcgagaagagaggcccttgtgtgggccactgatgtccccggggttgaggccagaggtggagcagcatgatctggaaggaaagcacaggcgtcaggttgcaacagaggctctcatcttgagacagcaagctgagctttagggaccagggagaccatggctggtggtcgccgcctggaagctgaggacagagttgtttatgatgagcacccttctagaacatccaccagcgtttgcagcccgctctgggacagctggagaaaatggcctggaggctggtccagggtgagcagaggtccctggcacacgtgggctcctaccaggagggctgtctcctatggcacctggcctgagtcactggaatggctcctgagccccccacccctaggccctgtgctcctgcctgatgttgcccatgcctgcgtgagcctggctggtgccaagagccaaagtgctcagatgatccagtgctcatggaggaccactgggcccttggccaggagcagggggccctcaaaggcacctccacccttgaccgcccctcactgacccactcctagctctgcacatatgtgctgatagcctgaagccatgtacctcctggtccccatctctaggcacccacgggagctaaaggtgtggccttgggaagggggcttcatggaggctgcagtgcctggggtctggatgcaaattactttttggggtgggatgagctggggtctgggctgcacgccctgcctggtctgtactcctgctgcactctcacagcaatgggaaggagagtcaggtgggagctgcggctgtccccggcccctctgcaggtcttctgctgtccattctcacagagggtggtgggaacggtaaatagaagatgacggagaatggccaggtgaattctaagcctgtgatatctgtgtgctgttatttttatagctctgatgtaaacctgacttctcatccaacccagacatggggtgtggagaacggcatagagctcagaactggcctgggtgctggagtggggcatgggtgggagtggaccaggctgacctctggctgggcccagagctgcaaggtccccaagcggtttcctggaccagggtgagctggagaccaggggggttcccagaggccagagggaaacctgaggcaagggcctgcggggcccgagcaagtgggctctgggaagagaccaaggctagatagaatccagcactcgccactgggctgtcctctaagggatggggtgggtttgtgaatgtgaaccccaacctcgtgcctggcaggggcccacagcaggcccaggggcccacactgtcctaatacagaagagactgccaccctctccaactccactcaccttttttgttaaatattttttcccccaactaattcccttggttttcctttgtgagttttgtttttgtttttgtttttgttttttatgcttgaagttttaaaactatagaaaagtacagggaacagacaccagcatatccaccaccagcgcctcatttcaaagaaagggaaaccgaggcagcagcccacagctggaggcctaggagtgtccatgggcatggactgtggagccgctgctcaccagggagcaaattgttctgccacctccttactcggagacaccgagcccagcccgagccacagggtgacaggacgtggaggtcacaataacctcccaagctcactgtgcttattgtgtttaaggctttatcgcttcagtccttccatacagcactgccactgggacttgggtggctccctgggcaggcagggctgaagctgctccaatgaaacagctgtggccaggaggctgggagggtggagggaggcggggtcctcatccaagcatccacactctgaggagggcaggggccactcccacccaaggacctgcactccccaaggtgggagagcctttctggccaccgatgcttcccaaaggcccaaacccactccaagggcacctggagaggcttcaggtcctgagccccctcagcattgcacggtacagcctcctggaggaggcagcaagtgaactgcagcctgcctgtgggcacaagaggaccatgtgtgaccccagctatgcccctggccagtcctccatggccccacaatgcccttctgccctggatgcagtgggatgcagagggcgggtcccatggaggctgatgcgcactctctgcagctgtcggcagggctctgaagcccctgctcctctccagcttccaaagaacctgcagcatccctggaggctgtggtatctgtcactcagggccagaaaagctccagggtgaaaaggcaggtccctcagagaggcccacacccagtcgctcactcaggcctaaagagagctcagactcagtcatgggagccacagtccctctaactcctgccacaggacaggcttctcgggcccaagtcacatcacaggaattgagggagctgggaaggagtaggtcagctaggggaggttagcagcttgcccaaggtccctggctgagtgcacctccagggccgggggtattttgcacttggctgcagggagctctccacccaggaggaaagctttctcaccactgctcttgctggcttctccctgagctcctccaggctccctacccaagctggtgtccagcagctggactccagggtcccctgacacgcacctagtgccctatagaatgcatgcttcacccccactctctccgggtggggctgccctgagcatttgctgtgcattctaattttcagagggagcctgagaacgtgaaatggttcctgtccctgttttatcgatgaatgtactgagactgctgagatcgagccacagggtagggtcatggagttgggcctctgagtttccaaagtgcttaggcagcccctgatgctgtctttttaaaaaggcagagcaaagcctgcctcctctctctgcacagacccctaggtcccagaggagctgccgcacagccacatacacacacacccacgcacacatacacacacgcccacgcacacatacacacacatgcacacacacacgcacacacatgtatacacacacacacacctgcaggagcccccccccccccgcccccaccgccagcaggccagccattcccctggctccggggagctaattacatcacaggaaactgcggtgtgagtctcacatcatcatggtccccagtggagcgccgagacagaacacatgtggtggagctctgggccaggcccagctgcctcaggtgtccccccagctggagcgcagccaggcgctccatgcagctcagccagggaagggccttcttgctaggccaagggtggttagagtggttctgagagaggcctcgggcccaagcagcctcctctgcttccttcttgggtgtcctggcctggggcatgttgtccccaaaacaggacaacgttagtcctgtcgccctcagggagggtatgtgagaccctgcctagaaaggcggcacacaacacctggtgcagaggcacaaggacagtgtctgtgacaacagaaacactgtctctgcccacaaggggcacattcagggacacgagacccacgtgcccgaggctccatcctcactcatggcctgggacacacgggtgccactctcttaagtgacactgccagtgagcccatggcccatgggaccagaattctgctggggactccaaaattcctacagagggttggagggctcaggcagggcactccaaagagacatgtgagctgaggctgaggggagagggcgagtcagatcggagggagaaagggcatggggccgagaaaacaacggcaagggcccctggctgcaagctccagccagagaggtgggcagtgcggcccaggaggaaacatggccggagaaggaggggacaggtctcaaagggctgggccttcagaaagaaagcgggctgtatcccactcacagcaggaagctaccaaaaggtgtgcatgacagtgacatgcacacaagtccttttggaaatttcatgctggctagtattggggagggcacaggatggtggtggctccagggggtgatggtaacgatggagatgcgaggggtcccaaggacagaagacctgccatgctgtgggggtggggtgctgacaggacctgccatgctgtggggtattgtggggtggggctgacaggacctgctatgctgtggggggaggggctgacaggacctgccatgctgttggcgggtggagctgataggacctaccatgctgttgggcagtggggcgctgacaggacctgccatgctgtggggtggggttgacaggacctgccatggtgtgggggacactgacaggatttaccatactgttggggcgggggtgctgacaggacctgccattgctgtgggatggggctgacaggacctgccatgctcttgggggcagttgacaggccctgccatgttgtcagtgggggttaacaggatctgccatgctgtggggggttgggctgacaggacctgccatgctgtgagggagcgctgacaggacctgccatgctgggggagctgagaggacctgctctgctcaggagggggaagggggagaagacagagagaggagggtagaggtagtggtggtgggggatgaagtccaggcatgagtgaggaggaggctgggttagtgcaggaagctgtaagtagacatggaagggaagagaggttctggggtagaatcagaatcaaagaacctcagaaagttcagtggagaaggatcctgtggttttctatctcccgaagtaaaatgagaggccagattttacctctaaccgccattcactataacccatccctctataacccctgaagcattccctggagacctcatgggctcatggaacacacattgaaaaccctgcagtgggccagtgggtggcctagagccatgtcatgggttagtgctggagcagggcagttccaggacattagaggccagccctgggccagctccccaccagctgaggctgagtcccaccagcagcatccctcacctgagagctggcctgaagtcctttcttcctttcccctgtccctgtttcagtgaccagctgctcctccctcctcctgggcatgctccactaaggcaggcatgcaaaggccagtagggaggcggcccctggactttcccaggcagacagcagtcccagaagagcgtgctgaaggagggacagactgactgctgcgtcctgggtcacccccacccaactcagcccacctcccaaagctggagcccctctcaatgtctcagccatcagggcccaagagctggggcagcttctcgaagctcaaagctggcaggggcaatgccaggctttgctggcaccagagggaccctgtgggtgtagcactgacttcccccgaagccagccgctgtgtccacgcagcctgaggacccaaggggaccttctggctgtcccagcaggaatccccacatgagtactcttgagccaggtgcccagccagcctggagatcacccaagatcctcaaaggttacagagggagttctgcctcctcacttcctggtcctgcaccctccctggagcaccccaggagactgcccccatactagccttgggaacatgggcaggttggagaccagccaggaatgagctcatcccctctgggggctgcctcctcatggcaggcccttccccgtgagggagagatgggggtcttccagttttctggctctgcgtggctatccaagaccacagtcctggggggcctgggaagcccagggtccttcaaccttgggccaggccatgggaccattccccagggcagagccagagtaagtgcaggcaggaaagtaggggtcacttttagaaatgggacctatctgcaggtgtggctccctgtcctgggaggagaggacagttacatttttttcttccatctatgcaatacttaaaggccaagagggcatttgaagcagacctcccatgttcactccaagtcacacagatggcctacactccctcattcatgtctctgctccctacttaggaggggctgcagccagggtaggggaccctcacccatctcccagtgggctctgggcactcacctttgaggtcaggcacagccacccctccctctgggcttcagggaagtttgggccgggtaggcatagggtgcctcctgctggcactcagggccaaggcacggagtcccttcttgggactgtggccacgctgagggggctgtcatgccatgagtcagccagctgtcagggacctggcccccaattcttccctcctgccctccccacagcctgcttcacactggacaggtgccccgactggctggcctgggtgtcctcaggggccacagcaggtaccagtggccgcagcccctggagggatgtcattaaagccagatcagccacaatccctggctctcacaatcccagccctgccgctgacaaccctgacgataagtgcaccccaaagaggaaatggggcccagaagcaaagctctgtgccatcagttcagctctcagacctctatgggccctgccacgacctgatgggctccattcctgatcaggagctgcactgggcatcagtcgcatgcccatggggtgggcaggggtgctcagcacctccagggagccctgactatgcaaggcctccccacgtcagatgtgcttttgcccctctgcttggagtcctagttctgccccacgtgtgcccagaacaatcagtgtctccaccctcaggccaagagcctgtgaccttgggttggagcctggccctggtgcaggcctgcggatctccttccacctggctctcagcctccagctacagggagtccccagatctgacccagggggccgagaccccaaagaagaggcctctgtgtcccaaccttgctgtgaggcatggtccactgttggaggggctgcagccactggatggcttctcatcgccagccctcccccgagggcgcaatgagactgctccactgtgactcccatggtccccgagtccctgtggaaagagccccagagggaaaggcggggtggaactgggctcccagcccccctacctgccagggacatgaccgaggcccctgggcaccccactttcaccttgggaaggaggcagcatggcctgtgcagttgcccctcctaatccacaaacgtgtggcctttcctgctgaatatgatggtgactgtcagcagttggtctcagcaggatcatcgtgccaattaagatggaaatgccaccctgtgggggctcccccctctgccagggagctgaagtggagggagtatgtttatacccaaatgcaaagatactgcccagcacagacttctgtcccagggggccggagagggatgtcattaaggccagatcagccaccacccctggctctccctgccgggaattccctggacagcaggagtaagtggcccttccttccttctctgcaaaagccccaaggtcacaggcacctctgaaacatgccccacactccccctgcttaccaggcctcatttcaggacctcctacccggactacactccaggcccagtggcgagacagagacacctgcagggctcccggattgggggcggtgaaaacctgcacggtgcacgccccagcagaccatagtcctcatgccagctggccagcagctgcacagaggctggtgggaagcaacttcctgacacagtcacccctccccagaagtgccctgtgaggccagggaggtgaggacaggcaacccctcctcagaagtgccctgtgagggctgagggagaagcacagtctcagctgggcctggccatggagacggatcccagtgaacaatattgattgtttgtgcaaaatggcaccccagcccctcagcctgcttgctgccagggcccctggtggaagctgacacagacacaaaggagaggaaggggcacagtgcagcaaagccggaggcagagcagtgaggcacagctgggggcccctgggccagcacaggcatctgaggcccagccacaagaactgcagtcccatagaggaaggggagggtgtcgcctcactcccaatctgtgcagcccctcagagccctgcacagggccaacagagtccgggagggtccctgtgcctgcaagggctgcggcctaggcctctgcagaacagggggaggggagcggccgcacccctgtctagacggctcctgctgagtactagctcctcacctacccgccctgggtgccacgggccccaaggcagagggcataagctctgtgcaaacatcctgccttctccccaggatatttcctttaataaaacaccatggaaatgtcagctagtctaaacaaatagccaaggttttcagaggacgagcagcctgcataggagagcctccagggcctgcttttcggggtggctttgggaaattgtgtgccagaaaggcagtgggagcccttcctggtggggcgagcactgggggttgtggtgactgagcccaaagaggcagggcctgcgagttcccctgggaggaaggggcaggccctgagccgggtgcagggtggctgtccagggtccctgaggagcctggggccttcagatgagggctccctcctgaggaccctcagaaagggcctgccccagggacacacgcagaggtgggggtgggaggcctacagcacatgcttctcaggacaccctccttcccctcccactgcaggagccacttctgcagccccatcctcctccttgtccataagctccatgttaggggaggcccctgcttggggaggccccaggtcggccgggggaggtgagaagtccaataatggggtgaaacttgcaaccccgtgcctgacaaaatgtggcccaggcccagcggtggcagggttggggtaggggtgagatacgtgttacagcccccggcagcatccagggcctgcatctgtgtgggggtcaagtgttcccgtgatcctactgcctgagcagcgggccgtggcatccctgctcttccttggcagggcagacagacccagctctatccatgtgcagggcaacgtgggcagggcccagactgcctccccagcaaagaaagattttcagggtgtggatctccatgtgggttcagcctctgtgaatggtgtgtccgggaaggggccacacgtgcaagaattgctgaccctgcctgggccagtgcaggagagtgaggctgggcttccaggcactgggctcgggctgtgccaggtaggccaacgctcctcaggaggccagcagatgcctgcagggtggcagtgagggtggtcccagcccttggggcctccatgcagccacctgcatctgtggccacgggtggaaaaggtgagcccacagcaggtgggatggccaaggctgagcaggtccacaaggagcagagatggaagccagcagccagctctgcaccaaggcagggcctctgggcaccgcctgggaagaagggagtgggctctggagtcctgtatgctgtgctagaatcccagctccatttcctcgcctgtgaacagggaagtggtttctagccaatgcggtgtcagaaggagagaacaggatgaggtgcctgggcacggctcagcactgagcactcggtccctccccagtccctctgacgaggcacccaggcaggccctcccctagcagaggacaccatccttgggcctctgggtggcagatggcattttctcaaaatgcccacaagagtatctccaatcccacacattctcagaaccttgctactctccaggagcacacctgtttccccttccttggaccgggtgcagggcagaggtggtgggtagggcccgcagaggccatgcagagtgaaatcagagactggggcagatagggcgactcatttctgcctgattccctctctagggaggttccccttggagcctggtcccatgctgtgaggaagcccaggtccctggaaaggccacatgcaggtgtcccacctgagggcccagcagcagcctccgctgccagaccgagcaccaggagccctcagatgcctccagccaacccagctgacacaagtggagcagagacacactgtccccaccacaccgggcccaatgtgcagtttggggagcagaattaatattgtcagtgaagccactgtgctgcggggtggtttgttaagcagcagcatgacggagcattggtgcactggctgagtgacaacatgactgcagcgcccccatctctgtcagactctagccaggggacggggcccactcagaaaagcctgtttcaggagacaggacctggtgaccattctgtgcctcccatcccgaggccccagacaaggctaggcttggaatccagaatgcctgggccctcaggacacagtgccctgccccccaggagccaagtgctgagacacgcactgttcaacggcctcattcagaggatcatgcacccgggaaccccacacagtcaggactggtgtttttcgtaggaggaatctgaggctccaggatgggctgagtcccttgtctaatgcgccctgcttgaccttggaagagacacgctggggactgatttaaagccgccactccatacgttctccctgcagctcccatgccagccactgccatccctgctgcaggagcacagctctcagccacagacgcccccatcaatcaatatttttaattacttacatgattgactaataaaattctccaccaactaattgatttttttgatcagagagagcctttgtttttattaaaaggctacttagatgaatttttttttcacttaagtgggaagttgtatttcttttggtcattttggaagaagaaaaataggagggggctgggacaagggaagaccccgaggccaagaagattacaggcccaaactgagagacccatgataatcatcagaaccccttcaccatgtgcccaccaaacacccagtggctcggctctggccagaggagccctgtggcatgggtgggcagactggggacacataccacccaatcgccagcagcttccatcatttttaaaggtgaactgtaaacttttctctgcattttaataaaagaatcgggcttgaaattataaaagcaactcattcattgtgtacagtttggaaaagaaaggcaaatctcataaaactatgaaagtgggcttcctggcacggggcccatggtgcatggggcaggtgacctgaagctgtgagaagaagctgcagggttgacttcggtttcccaggggcccaaggccccaaagagccatgaccataaaaacaatctggacagccacccaccacccagaaaactgctcatgggctcacagatcagtgggctttttgttgttttcctttttcttttcctttttatttatttatttattttagagacggggcctcacactgttgcccaagcggcaggcagtggtgcaatcatggctcactgcagccttgaactcctgggcttaagcgatcctcccacctcagtctcctgattaggtggtactaaaggtgtgtgccaccactcccaactaacttttaaatatttctggagagacaaggtctcactatgtggcccagattggtctccaactcctggcctcaaactgaccctcctgcctcagcctcccaaagtgctggcctcccgttttcatttttcttttaccagattggcatcttactgtagatcaggtgtggccatgttcctccacttgcagtgacctttaaagaggtgtttgtaagtggctccagggcagcccatcctgggacctcttcatgtggcacacactgaggttgtcttccctgggcagctgctgggcacaggatgatgctgggcacaggatgattctgggcagctggtagggccagggagcttggcagcgacaattagggtaagggatggtgggcatgtttggtgaaggaggggcagggtacagggtccccaccacagccatgggatgctccttctctcctggctggagggtctcagccagggggacacagtggacagggggtgttgcccccagctccacactgggcctgccactgcctctgcctgttacttccacagtcatggtcacccactgatttcactgtgacctcatctcttgttggctgctccatgccctacgagcagagcagtacccaggatatggtggatgctctgagaccaagttacaaatgcttgctgagtaaccctacagaaatgaagaacattcttaccgtggcctccacatggcccttctgagtggggccctggggctgtggggaggatgagcctgctcccttaggagggtcactgcagatgtgcagaatgacaatggaatgcagaggtgatgggggcagagctgtccctgtgtcacagctcatccacacagactgggtgagggctctgtgcctcatgccagccccatgcacagaactgagtcctcgaagacagagggactgagtgactccccaggccacacagcctgtctggttctccccatgggacgcttctcaggctcacccggagctttcaaaacagattcctttgcccgtgacctgctctcagcctcatgtgaggcctcagaccagcagggttggaacagagctaatgacatggcagggaaacatgtggatggttagcgacatgaaggcccacccagctggccctagagtgtctcgcctgcctgacagctccagtctgtcaccctgactgggcatgtccagaagcctggccctccgtccttggtgatctcatgctgcgtggcttgcacccgctgggagccgatgccaccacgccaattgctgcaagcctctgaaaggcacctcgaggtgtcctgatctgtccccaacatgcaacctgcccctagatgccctccccaccacagcaggaggcagttttgtcctgctcaattggaaaccctgggagctgagtgaccctgccgtttcccccgcccactgccagccacatccctgctgagaaaaccaagaagggagttggagctttgatcctcactagctggtactgattcccccacctgcagcagtgtcagagaagaccacacagaaagccagaactcccattcccacccagctgtaatgaggagtccccacctgcacctcaggtgtcagcagaggctgagtgagaatcccaagcttctacttctacctggcagtgagaaggtactgcctccctttccctgacagaggctgacagaaagtaccagctgaaacagaggcttaaataagacccagaagccgggcgtggtggctcacgcctgtgatcccagcaatttaggaggccaaggcaaacggatcacaaggtcaggagtttgagaccagcctggccaatatggtgaaaccccatctctactaaaaatacaaaaattagccaggcgtggtggcgcacgcctatagtcccagctacttgggaggctgaggcaggagaatcgcttgaacctgggaggcagaggttgcagtgagctgagatcacatcactgcactccagcctgggcaacagagtgagactctgtctcaaaagaaaaaaaaaaagacctagggtctcataacaaaatatgagaatatctaggtttctaaagagaatttctagtcataccaaaacccagggaatctcaaactaaatgaaacagtcaataaatgctgacatctacatgaaagagatgttagaattacctgacaaagatcttaaagcagtcatcaaaaaagtgactcaacaagcaaatatgaacatgcttgaaacaaattgtaaaatagaaagtctaggcaaagaaagagaagatacagtacaaagaagaaccaaaggggaattttagagttgaaaattacagtaacaaaaatcagtggatgggcttaacagaatgaggacaaagggaagaatcagtgaataggaaaatgcatagaaatcacctggtcaaataacagagagaaaaatagactgaaaaaaataaaagaggaatccaggagactataatacaagacctaactttcatgtcattcaagtcccagagcaaaggagaaagaggattggctgaaaaaatactcgaagactggaaactccttgaatttggcaagagatgtaagcctgcaggttcaagaagcttcataaaccccaagcagaataaaaccagacaaatccatgccaaaacacatcataattaaatttctgaaacataaaaaaaagtcttgaaaacagcaagagacagctatcttggaagacagttcagatgacagtggatttgtcatcagaatcacagaggttagcaggcagtggtataatatttttcaagagctgaaagaaaagaactgtcaacccagacccttttacctagttaagtcatccttctcattcgcattctcagatgaagggaaactaagaaaatttgtcaccagcagacctatgctaaaagaatgcctgaagaatctgtccagacagaaagcaagtaataaatgaaagaaccatggaacatcagtaaggaagaaaaaatgcagcaagcaaaagtatggataaataaaaatagggttttgttatcccagagaaatgaagacatgttcacacaaaaacctgtgcacaaaaatttatagcagctttatttgtaatatccaaaaactggagagaaccagctgttctttatgaaatgaatggtgaaacacactctggaatagccacaccatgaaatactgctcagcagcaagtaggaacaaacttctttttttttgttgtttgagacagggtcttcctctgtccaataaggtggaatacagtgacacaatcatggctcactgcagcctcaacctcccaggctcagatgatccttccacctcagcctcccaagtcactgggaccacaggcaggtaccaccaaacctggctaatttttaaaaatttttatgtagagacaagatgtcactatgttgcccaggctggtctcctgggcgcaaatgatcattcctcctcagcctcccaaagtgctgggactacagtcctgagccactgtgcccggctggaagaaactattgatacaatcagaaacctgcatgaatccccagaattactctgaatgataaaagccagccccaaaaggttacatattatataattctaattgaaatgccaaaattatagaaatggataactgattagtggttgctagggattaaggggtgggagggaaatggatgtggctataaaagggcaactagtgattcttgtggtgatgggatattctgtatctccactgtatcagtgtcaaatcctggttgtgatactgtattacagttttgtaagatgttaccactgggggaaactaggcaaaaagttcagggatcttctgtattatttattacaactgcatatcaaactacaattatctcaaaatagaatttttcattttaaaaatatgatgataagattagaaacagacttgtgtcctgactatattgtttaattactagagattttgctatataaaaatattaagtactagagattttactatgtaaaaataatcttgcagtggtgggggatggggagttattcctccggaaaataagacactgagatgcctagagaaaaagatgatggatttgactagataaaaatgcaaaacgtttgcatgactaaaggccctatagacttcaaaagacaaaccacagaatggtttattattatttgggtttgtccactgtctcctcgatattagattcaggtcacgcatttttggcaggaatgctgcagacctacttccgtgccctccttgatgcaccacaccaggatgaatttggaagtttattccatcactgatgatgatatcagctttcactatttggtgaagtcaatattcatttgtagtgaaaattcactacaagacacacaaaatagaaaagaaatttaatacaaattcaaaaagcatttcatttagtaaaaacaaaaatgatctaatagaaaaatgagcaaagattacagatcatttaaaaaataacaggaagctgcgaatacgtgaaaataagctcaacatcactagtgatgagaccaatgcaaattcgagtacctgtgagttgccttttttgctcctaacacattggcaaaattatttttctccttaaaccttgtgtttgaaacaattccaaacttagagaaaagttaaagaatagtgcaaagaactcctatacctcatctccccagattcaccactgttcacatttttcttcctgtgttctcttttttttccctgtccctcccccactctctccacatgtatatgcaatttctctcttgaaccatttggcgatgttacttctattcaccatgcctccttgctcccaaatattaaatctttatcttccgtagacaaggacatgttcctacttagccatggtacatctgtcaagtactgaataggaaagttagcattgatacaatactgttatctaaccaaaattcatattccagttttgtcagctgtcccaatgttgtctttgacaataatttttttccatccaggatcacgctttgcatccaatcatcctgtcccagtggtctctttaaactgggacaccctccaccttcctctcctctagcattcacattttggaagggagatttccacttaggctgtagactgtgcctccatttgggtttttccactgtctcctcaggattagattcaggtcacgcatttttggcaggaatgctgcagacctacttccatgccctccttgacgcaccacaccaggatgaatgtggaagtttattccatcactgatgatgatatcaactttcactatttggtgaagtcagtattcactgggcttctcaattaaaaggttattatttttccttttgtaacaaaccaggacttttatgggcagatactttgagtctatgtgattccgtgttcctgcacaaactttcaccctcaaatttagcatctgctgatggttgttgtctgaatcagttattctaattgtcaaatgattatctttctaaattccacctacttttactagctgatgctttattatactataaggacaagcttttccttatctttttatttcatatcgttattggatgatgagctcatggagtcttattttattcaggggccataattcattcctatcattcattctgatgcccagaatgtcccagctgggccaatgggagcccctttgcttggttcctgtgccctgtaatatgctttccttgttctctgagtccttccttactttcagtgagatgttctaacctcattttttttctgctccagccctggaaacttttctccagggagccctggttccttttagtggagacagaatttagaaaccaagatgtgagtgctgggtgtgctcatcgttactctagaattcctgaaggcctggggatggagcgctctcattctcacttcggggagagagctgatgcaacagtttaaggggcatttggccatccttgtcaaacgtggccatgtgcccatctgcacacagacacaccatttgcaggaatctgttcgacaaagaggagcacacaagtgcataacaacaacccgtggaagcaaccagagtgtccatcaaggtcagctaaaaaaaaaaaaaaaacactgagctccctccctttctaaacgacactcagcgtacattgaaaataataagactgatttgttcaagttcaagaattactaaaggagaagaagcaactaatagagtggcacatgtaatctgatttttaaatacatttaaaataaaatgtgtgtgtgtgtgcgcgcgcatgtatcttatatacatgagtgtgtttgtataggaaatactctggaaggacgaagtccaagctcccaagtaatgttatcgctcagagagggtagtgagcagaggtatggaggctggtaatacaagcagaaaattatagtttttatttcataaacttctgaactatttgaagactttatagcagccatatagttcctctatctgtaatattttttaaaagtgttaaaagacaataggccaaaaacgacagccggctctctagcctacaaaactggccagcactgttgaaatatactaaagtagttttaaaaataaagagaaaggtactcaccagaagtgggatcaatcggccttggaagcagaggaagaagagaaggaagaggaaaccttggcagtgtttattgtacctgccctggagcagaggtggggccctggcccatcttggttctctgtgaagtggccctgcaggctcttggggacatccccaggctcttgggaacatccagctccccagctctgatcctacccaccactggcttcccctgagtggtccacagggggagaggatgtagtggcaccagccataggaccagaggtccctgacctgggctgtactgctcttcctcaacttctgatcatatagatggatccgcacgtggtcaggaggatggattctggagtcagactttctgaattcacaccctggctcaccgctcactgacttggaacttggaacatggcaatttcccccctacccaacctctctgtgcctctctgtgcctcagtttcaacatctgtaaaatgtccccatacagttgttggaaaggtcaaattagtaaatatgccaagtgcctaggacagtagctaggatgtagtagactctccaaaacgattgtttgtgatattattcctagaagtcacagtgggcacacccttctcttttttcagaatgtaacaggaatgaggccagggttttactcttaggtgtgatattcctgatcgtttgccatagtggtgtgtattcgctaggaatgctttcaactgcaacagttccaaacatagcagcttaaacaaataatgttttgttttgcctccatttacaagaggcctgccagtaggcagctgctggcctgggttcagcagttcaaccccgtcagagctttgtctatctttcatgcattctgcctcagggttgcaatatggttgccccagtgcctggcatcacatctatcttcaatgtaggaagaaaggaaatggaaagaaaagagctgcatttggctcttttgacaagaaaacaaaccttctcaaaatatcccagctgactgccacttaggtctcatttaccagaactgtgtcatttgaccacacttagttcaagagaggctgggaatatatttagacttttagcctcaatagtgcagatctcaagggaaaggcggttggaaacagcctcatggagcttgccactattttctttatcccattaagaagatccgtatggcccatgtttgagtgacatgtgtttgagtgaggaatggttggtggcatacaccaaatgttttctcagcagagggaccatcccagtgtctctatcccgctcctactctaggggtccaattaaatggagtcccacctattatgaagcagcagcaggggaaattcatctgtgggggcagctgggagctccaggacttagcaaacctgacagcctgtgcagaccaggatgcagggcttccaaccccagccacctccctgccgaaatggccaccactgccagctccaggttgctggaggaagctggaggctgccagtttgctagctccaggctttgacagcaagggcatctctggtcagtgcctcctggattgttcaacctgtttccatcttccaggctctcaggagcactgggcagtgcagtggggtgggggcttgggagctcccatgtgtgacagacacagctcccagcttcccttcacatccgcaatgcaggcctggctgatggtatctagttcctgagaccctgcagtgaactcagatcccagatactttcccttgataacagcttcacctttttcatctcttttaacaaataccaactcctggctgaaacccagactcctggctggataccaagtcctggctgaaaaccccttgctgcttcccagaaacagcctggtctgacatggtcagtggagaagagagtgggcctggtgcccacagccacttactgccttctctgggccccagttcctcctggtgaaatcgagagggtgggtaggatgcttcctggctgccccctctgtgcacaactggtggctgtgggtcctggttgcccctctgtgcacactctgtggttgtgagtcctggctgccccctctgtgcaagcccagtgggtgtgggttctagtcaccccctctgtgcacacccggtagctgtgggtcctggttgccctctccgtgcacaccccctgatgtgggtcctcattgcccctctgtgcacacctggtgactgtgggtcctggttccccactccgtgcacacctgatggccatgggtcctggttgccccactctgtgcacactcagtggtcacgtgtcctggttgccccattctgtgcacactcagtggtcatgggtcctggttgccccactctgtgcacacccagtggctgtgggtcctggttgccccactctgagcacacccagtggctgtgggtcctggttgccatctctgtgtacaacctgtgattgtgggtcctggttgccatctctgtgtacaacctgtgattgtgggtcctggttgcccctctgtgcacacccatcttgctcctcatctggatgaagtcactgcccatggtggcctcatgcagcctgtgatgctgggctctcacttgctccactttccagatgaggaaactgaggctcagaaaagctgtcccttgcctggatctgagcctggtcttgcagcccagagctcttgccacctggctgcacccctggcagtgaccaaaattgttggtcccgacccagacctcagagggtcagtgaagagtgtcctgggttggcttctcctcccctctgcaaatcctctcagcccacactctttcagcttctcacagaccacatgaaataatgtgatagatgcaatatgagattaggagctgaacctcacccaggtcaggaaattccaagcgcagtctcccagctcagctctggctcccgtatgctgcccccaggtcgcagcggggtgtgcaggggaccattgcaggctgcaggggcacctgcatcctctagaacttcctgaagaccagacgctctgattttccaaccagcaccagcccagtcatttccctctgcctccctggggactgtcccagccgccatcccttgctcctgcctccctggggactatccaagccaccatcccttgctcctgcctcatgcgggtttcctctctagccagatcctccccgtctgtatccaaaaatactgttacttccctgtccttaagacagtgtgtttgactgctttgcttgtttgtttgctcctcttgatggtaaaactgctccagagatgtggccccatctggggttgccccactgaagccctccacagagactttgtgacacctgaccactaacctcacctcgctaaactgaggcagagcttggcaacagtggtgactcagtggctcagccctcctcttgaaacaccatcctcccgagttccaggacccctctgccaggcccctccctccttctccatcccccacacctccccccatcttcccgtggggggacccagtgctcgtctctattcacactctacagactccgcgtgacaccaggccccacctctgcaccctccacctcaaggatggatacaccttccgggctgtacccgtgaaccccagcctccaggtctacccaaaacctgctcaccatcaccttctcaggtacaaaaacagccctcttccctcacacccccaccgcccaacctgtggtctaccttggaaataaacctcacacctctggtcatctctactgccaccccactccccacccaaaccactcaacagccacctggacctgggaacatggcagctgctggaggtcttaaaggcgccctttccctaaggtaagctgaagcccagatgccagcacagccccttctcctctctgccctggtccccacctcctctcaccccctcactgtactccagtgccctggtctcctgagcaccctcaaacacatgtccccaaatccaattccgcccccaggtcccatgattccctctcttccttctacaactcatttctcaaataactcctgccctgctatcccatcttaaaccgcacccaccctggtgttggttagccagtgctgaggaacaaatcagcccaaaccttaggggcttctgagaacattacagtcttagcttctgcgggtcaggagcctgggcatggctcactgccacgtcccccacccccagcccagggtctcccataggctgcactcagggtccactggatcgggtcatctcagggccgggtccacctcaggctcccttacaaggcaggaatgggctccctctcaaattgtagcaagggctgccccaagtccctggcacacggtcccccagagcgctgctgaggacatcgaagcaagcaaggcaagagagggagcaggcaccagtgagacaacccacaggcctctgtcagacgggggccttgggggtggcagccatcccttctgccttttccatccattagaagtaagtcctggcccaagcagcctctggggaagggcagctcaagagtatggccccagcagtgggcgtgaagctctcctccccactgcgagcttctcactccccacgtaggcggctccagtgcccagctctttgtctgtctccttcaaggagaatgcaggctcttgagggcagggcactccctgtcgtcccaagcttcatccccaccacctgccctgtcacagcatcagcacagctcacagcaggtgctgaataaacactcgtgaacttcagaaagcccctcacagcacaggaggagaaatggccatcctccccagagacttcgctggcattttcctatgttacagcctgatcctaggacccactgaaggctggtttctgcaggagtgaggaagcctgggtgtgagcccctgaagctggggccatactggttatctcggcccagcggcctggaaatcacaccctccccagacttgtccccacatctgagaggagagacacatcgcagagcctggcctcgaggtctcaggggtcccataagggggtggggctaggttcattcttttacatatgttttcaaatattgctaaaagtcataaattgggccaggcatagtggctcaggcttatggtcccagcactctgggaggctcaggtgagaggatctcgagtccaggaattcgaggctacagtgagctgtgattgcaccactgtgctccagcttaggtgacacagaccctgtctctttaaaaaatcataaattgttagacatacttttggggaagtcgtttggtacacactccttgaccagtatgtccagatcctggaattactgatttttttctatagtcacacatgaatgcagagatgtgcagtgcagctttgtctataggagcaaacaaatagaaaagctagatgtcctcgagtaggagtggatgaattattacagcacagccccacggtggaacactgcacagccactggagtcccaggcagagccgcatctgggtgcatcaccatctacctctttatgtaaccagcagacagctatagggcctgcaccttccgagcactggaggcagggaaccgcatcgctgccttcaggaactttatgtcagggttaatgccaacatgcaaataagaatgcaaacacacagacaaatgcagctatcacaggggtgtaaggaaggcagagcaggacagggagattgggaacatgtttcacacagcaatccgggtggctgcgcagatgccagggcacagtgagggagaggctgcagcaagctggggccggcccctcccaggcaggaggaatggccaggcagggcaggtgggggtgagccagggtgaggaggatcctgtggcacctggcagccacactggcattccatactgatctgtgttacaacacaggcacccacctatcagagcagcctgggccactcgttgccagctgcagacaagggtcaggctaactggtgctgataagacaccagcccccatgcacctggtgtgatagggcgttgctgcctgccagtgtcactctggagcagatcagcaggggtgagggcaagggcaggggccgggaggaggctgcatgacccagggtggggaggccgacctagagaagcagagtggggcaggtcggggagacagatattctgaggggcccaggacctccacgttctgagacgctccgcacacagcttctggaaatgttatgtggaatgaaccatcatctggtctttcccttcttttttttttttttttttttgagttggagcctcgctctgtcacccaggctagagtgtagtggcatgatcttggctcagtggaacctccacctcccaggttcaagcaattctcctgcctcagcctcctgagtagctaggattacaggtgtgtgccaccacacccagctaatttttgtatttttagtagagacagggtttcaccttgttggccaggctggtctggaactcaacctcaggtgatccacctgcctcggcctcccagagtgctgggattaccggagtgagccaccatgcctggcctttttctttcatagacctttgagattgccgaagtcccttccaagactcaaatctactggctcggatacaggacatgggcatttggagtagacctccacccagacacaggaaagtagccccccatctccgtcctcactggggtccacttggcaacccagcccagcacttggacacggatggcctactctgccccagtgcagacagctccaggtaccaggtgctcctgagccctggccacaggtcagaccccattctgagaatggtcagaatccagagagaggcctcaggtcctgtgaccccgaggtgctgaccaaggacctcgcatgtgtctggcagcatgctgggcctcacaggaggaaagggggccctgggcccttcatgtacattgctgcaaggtgggcgctgtcatgtgacggggagtgtggaggcctcgggtggcccacaataggcagtgggaggacaaggccagggcccagcgcctgcaattctccatcacaccctgtgtgctgagcagccatccttcaccctcaggctcctcctcgtgggggcacaggggaccctggctcggggagtccatcacttgcacaggtgtcacaggcatagaagtccaaactcaatggatgcccttgcctccagctcccagctgaacatcctggctgaaaggggctgaccgccctgactttcctctgaggtaggtgagctctgggggctccatgagggaggtggctgtgtccaggccacacatccctctccaccaaagcgtctgccctgatgacatcacctcacaccgccaagccattactcacagaattacggcttgtctggaagttggatgagatgtatacaatgcaccaggatgacaaatcctccctttgagtgggtcatttcccgaaggagattccaaggattcacagatcagcgtatcctggcattgcaggcagtggaagccgaggcccctgagatgtgtctgggtctagtctcgctgtgctaatgaggccccagggccagagtggacactgacgtccctgtggggcagtgccacatgatcacatccatgtagtgaagaggcattctggactttgtccctaactcctggtggtgaaccatctttggaacctgatccctgggcccagactccctggtgggtctgacctctagcccacagcacagcaggttgcagatctcattgtccagaaacagccacagcaatatttctgtgttcctccaggatctggccaccactcattgagaggcagagtctatttctcctctccttgaaaccaggggtgccttcacaactgctgagatgaagaggagagagggttttaggtgacttccgatgatgggtcacagacagtaacgtgactctggccaccacattgtaaggaagcccagcggtcccggcccacagctccagcaagggagctgttagtcaaccgacagtcaacaacagccaccagccaccagttgcatgaggggagctcagtgttgccagccccagcccgcaagccgcctgccctaaatgagacagagctgagcagagacaagctactgcacggagcgctgcccggattgcagactcaggagcaaggcaaatgatggtgttgctttaggacactcagcttgggggtggcttctcattcagcgctagacagggagaacacaccctaggtgattccccggccttccctgggacttctgtgtctgcagatccctggtgcagatcccaggcaggcagagggccagagcccatctgcagtgatggttctgcatactgggcgggctccgatgggtcgagaacagctccttgggcctgggggcaggactcagagccacattcacggctgcaggagtcatggatccgtggccaccagggtctgtgacagggaaagcgctacaggctggaagccctgtctggggttatctatttaatgggagataaagttttcatagtactaaaaagtattagtcttcagaattagatatttgctcatttttccaaaggctgtgaggtctctgaatccctcctgcagatctgtggcaagctgtgcactgtcctgtagagaaatggccctttctagatctccactctaaaagcagcaataacaggacgatgcgagagcagagcctggccccaagcagcgtgggtccccaggcattaaggatcctctgcaatgggtttcattagatgagttgtctttggttttattaaaatatgtatgccctttttattaaggcagtattgacctgtgaccatgtgggaggacaagcccatgccccagtctctggctggagggtgttgccccctgggcctccacaggcttcctgatcaaccaccctgccatccatgggcacagaaaacatcaccaggacagcaacagggggaaggcagagtgcagctcccaccacgccgtggtccttggggtcctcagttggagatgagggctgcagctccccacctaggtcacagcccatgcccctctatcccagcaaccactggaccagcctctaccaaggccaccaccaagacagcaccaggccaccttcccaccagtcagcagcttcctctcaacctctattcgttagtaaataaattctgattcatgaagccataacaaaacaaactaaacaacaaaaaaacctatctaagacaccaacatccctgaaaaacaaacaaaccaaacaaacaaacaaaaaacaaatggtgctctgcattccctaaagtgaattcctttgcaatgtacatgagttgctggggctgctgtaaggaagggccatagactaggtggttaagtttactgccccccagttccagggctggaagtctgggatcaaggcctccaagggccacccgcccccttagggtgctagggaagggtctattccagcctctccttactcatagacagctgtgtctccccacgtctctcctcatggtctcccctctgtgtgtctattggtgtccaaatttcccttttataaggataccagtcatactggatcagggcccaccctaacgacctcatctgaccttgattacctctttaataaccttagctccaaatacagtcgcattttaaggtcctggggcttagcactccagcatgggaagtggggcctgtcctgagtcagcccagggtgggcagtgggtatgggagttgcccaggctgctcagagcagggcacacaaaggaggcagcagcaaagaagcactgggaagggctggttctcccatcatcagggacaaaggactgagccccccaacaccagctagccctgcggggattttgctgggagctgtaagaccagggtccagcagaagcagagggcacacgaagggggcagggactggggtttcctgtaggggcagaggtgtgggcagtatggggaacccccaggcctggagagaggctgacccagcaggagctcaggggatggtactggacctccaaacctggctgagaaagagggacttgggtgtgggggtgggggtcaccggggccttgccaggagggggcaggggataaacacactgtcctccccttgctggtctcccccagggcctccaggtggagggacgggtggcacagttcaaccgcccccacccctccgccatcccccttctgccccatgtggtgtatgcacaggatggggcagagctgagcaagcacagctcctaaagaggagggcaggaaacttgctgctcttacagccctgcagccgcggggaggcttgatgctcccagcaggggaaagcagagaggcagctcaggcatggccagcaagggcttagacttacaactccttgagggcatcagcagcacctagactggggatggcagagtgaacagtggctcaggcgagcttccccgaagtggggagtgcgggcccatcattctcacagagccacagtggtggtggatcacacaaaggggagaccatgaggagagacatggggaggggacagctgtctacaagcaaagagaggctggaacacactcttccctagcaccttcagtaggtgggcagccctcagaggccttgatcccggactatcaatgccatgagcatctccaagcccaggccccgggagggggccccactgcatgggcctcagacagcttctgaccagccagccccaccctgccccacccttacctgccctctccttccctggagaagcttgatgagaggggccctgggccaggcctctggaaatccttctgctgcaggcctagagctcaccagggtggaagagggaggggatgggatagcccagatgggcccctgctcccagcagcctccccaccccctgaacactcccctccaccccacctagccgggcaggcccagctggccccatttctcattactattgattatggtggcagagacctgcagcacagaatgtaaatcagcatccctggggtatttaacctaggaagggttaggtggaggtggcatcccttataagtcctgcatctgatgtttttatattaattcctatagtggccagattaatttttattccactgactattatctcttcttcattgactaggagacatttctgagaagtgcatatgtgttgagtatcagtcatttagtggggggcttccctggctgcaaggttttcattaaagaaggaaaattcctttgctccaaagactcagtctggaaataatgcgcaggccagctggtgtcactgccagtgctgccgtcacctgggagtggggtctgcagctgcctgggagcctcaactaaaggggcagggccccctagccgtccctcatcctccctctcctcccagcctcccaggcccagctttggcctcacacaggctctgagtgagccttcagcaagtgaccacccccagctcctcagcccttgctctgtgctggggcctcccctcccacatctcacagaatccgtgccccgactcggagtgaggtgggactgtcactgcagccattttgcaggtgaaggcaatgcacttgctatagattccctgacactcagtactgtacagggtcatggattatcttgggtgggatccaggcctagatcacagaaatgaccaccctttttgatggggtggcagaggcactggatgggtggcttccaagggctccgggccttgcatgaggagtccagctgaaaaaacgggtgtcagaaggccgagagctgtctgcaaacccaagtctctgcagagtgtggtgtggtgtgttctaggagcgtccttccccgctgaccagtaaggccagggccaggggcataagtccagggcactgaggctgggaacagagaggaacatggggaggaggatggaaggggggctcggcagctccggggatgcctggccaagctggacatgctgccagtaggtgggggagtgcctccactctgagaccctcacctgtccctctcccatcctacagggttgagaggagtggatcccaagtgtaggcccaaatgtggagccagcagcaacccagccactgggagctcatggcaagtgtacaccccggcccacaccccacatcccaccctggggcctggtgaccagcctccactggcgcttgggaaccatgagcagggtggctcaagggccccagagaagaaacacctgagctggagcctcagttagctcacctgtaagatagggatgttgctgccacctggggatgctgtgagctgagtgaattggaggggccagtcctgggctgcctacttgcccacatggtagggaggatctccaccagctgttctcaccccccaaaaaagagggctgcctctttgtccagaagagatgattcagggaccaaagctttacctccctgagggatctcattcagcctttcttccaggggccagacatgcataactaaaacccaaacctttatgatttggagaacgctgataaattacaaatgcaaatgggtaaccaggcaacagccccccccgcctgatgccaggctgggtatcagggctgggaaatagagcagaggtcacttcctcccacctggcacaggtcacgagagcctcaatgatgtgtcctttacaaagctgcttttatttagttggaagctgcttcagagacaactgtgaagacaaaaaaggttgctgtgtgtggtggctaagacatcagctgcatctgaggggctggattctgcaaggaaataaactatgaggcaagagaaaggctttagaagatcctccaactgttctcatcgttctgttagctggtctcctgatgaggttctgggtgagtctcaggggctgaggaggtgagttcaggcccctaggagaagaaggaggggggaaacatttcccttcccagtgtgggcctttctacacctacccctcatttacagcctgggatgaatccaccagggcggctgttcacacacaaccctgtcctgaccccgtcccaaccccgtgcgcaccacctcccacccaggagggtgcctaggtccccatgagtgcagggctgggtgggtgagggtttgaggcaggccctgagggccaggcccagggaggcaggatacccacagaggtggaaaccttaggctgactttatcttggctccagtgccggagctgttgaaaacgtggccccaaatgtgcacagaagtcagcagggtgaagggtgagctgccttgcctgctctgccatcaacatggaggcctggaagctttttgcagccctcaggaggggtcctggaaaacagtgcagacacccgtcccgccgggcctggaaaacaagcgagcaatcagctcagcctggccctagaaccacccacccaaactggccccaagccacagcacggacgatctggtgtgtagtgcttagatgccagcctcactcgaagatgagttgcaactggggctgcaattccaggagggcacccacaccttcacagctcagccccatcttgggctgagactagagcaactcaggcaggatggagccagccccaccagcggctgcttggtatccaggcctaaactgggcaaagggcggctgcaggaccctgggcagggcccaggacggatgggtgggcaggagggtgggggcccatctctaagccggaaggagaagcttccagacatgattgcatctgaccttctcctagcgtctcctctctctggctcagggcccactgtgagctcagctccgcactcctgggtttcatcctggggaactttgtaaagtatccaatctacagaaaattgccaacctctggaagcctcagcaggaccaatgtcctccatgcagagcccttcttatcccctaggaccgcaggcccaggctcctctgggggtcagggcggggcacagctaggagggaaggggagttgctctgggtaagtaagatgcttctaagcttctaaatcaggttccagagagacccccacccctgatcccccaccccctgctggcctggagcactgaggtcttccaaaccttccagaacattctcagctgagcactcccagccctgggcaaatcccaagggaacctggaaaaggaagcccctccccttgctgggattatcgtacccttatgcttaaagggccagagggagaagaatgtttctgtgctttttagagaaactctctccacaaaacacttcctgatgcttgtctgacaccaaaaatctattaaagtcataaagttctcctgcagaacgcttctcaaaaatgtatttatctaaagggcatctgtgtttggtctccaacgcaaacgctccaaatgtcgggccccgggtgatttatttgggcgccttgttctctccctgcgagttgttttcagctcaagcccctggttgcgtcgctccttcccctgatgtttatagatggcttccatccgctcagagccaggccggccaggaagaaggggcttggaggagcaggtgagcgtgcatcaaggggctgcagagagtggggcagcggacagatgctcccagcagacccctgcactccccacctgctggctgagcacactcctggctgtcctccctgcccagagggcattctcctggcagacatttgaacagcagctaggaatcctcaccaggtccccagctgccctagatgctgggagttcagcagtcaacgcacctgaacccacgcaggcagacggggaacatgagacagaccaggaacagacaacaatgaagagtgatgcagggagtctggggccacagacattgcaaggccttcctcaggccacagggaaatgcagcacagctagggcgctaggctccatgcagcgccagtgccaagcatctaagcagggtgggaagaggtgacttctgagtgatgagtaggagttggacaacagaggggctgggaggagccaggaagatcctcccaggcaggtgggggtccaggacagggaacacctgggagtctgagggatggggagtctggggcagaggagagagggctggatgctgaggtcccagcattagtgatcaggcctgggcctctggctgcatacagagtcccctgacagctcttcatcagcctcttaatacgcagtagctcatcagcccctttccaaagaggcccctgagggcagggctctgccaaggctgagctgtgtctgtgctcctagccatgcctgctgtaggaaggaagtcctggggctgggcctggagggaagcagaagactctccagatagggggtgcccagggtgtacccctgcagtgccgcccgtctcctcagggctgtgcattttcaagctgcctggaagccagggcccagagggaatgctgcaagagcagagttccctggaacaattcaaccggctgcttctctgctctccttccagcagggaggtgggtggcaggagcccatcttccccaggcacccccaaggagaggctacggagatgttttttagagctgcattgctcaataagtatcctggccacatgtgaatatttaattttacattatcttaaattcaataaaattaaacattcagttcctcagtcacactagccacattttaagtgctcaggcagcacaaagttcaacatggtcatcgtcgcagaaccttcccctggacagacagagcaagcagggaggggcctctctggtttgtatgaggggtccaggcatggcgggaagccctgggcaggcctcagctcaggtagcagcacagggtagtgcaggggctggaggggaagtcctgagggctctgcctgcaaccagccccagggcttccaaagcaacaaaggcctgcgggagagccggaaggggtaccaagtgcctgggcccagtgcagtacctgagcaagtaccaagtgcctggaccctctgtagacacaggggctggaaaccacgcacgacctgcaccctgcaccccacacccaagggcaagcaggagggaggaaaggaaggtggccggcaggcagcttacagttccctcctgtccctgcagctcacagcagctcccgagtgtggagcaaggcaggctcccctgtgcacccacaggcctggagggccctggcagatacacaccttgccagagccacagccacctccatcctgggcccatggcagcctgcagacaccactggggcattcagtcactggcttcctgtttgtcagcatcccaaagcaccacagggttttttggctccaaaagacctcctgggccaaagtgagcctctgaaggtcctgcgggcaggacacctctcagaggacggagggcgcactgcaacttccagggaggccagccagaggctgctgagaggatgctctccgggaagggtgaatgcctgcctgttcctgctggggcactgcggggaagccaaggttggctggcctcccaccacctcccggtgtctccagggcagcactgtcccccagcaccatcttctttgcccaaggtcagctcccggggccgcccaggcctgacaaccatcacctacatctcttctgccttggacccctgcacacatgccttgagtttgggagactgtcccctagatgtacggggaatggagggacttggttttctccactgcaacgtctctgtttccaaaaatggtgcctggaatatagcaagggcccaggagatatctgtcaaataaataagtgggcttttcaagaaggacgaagggcaattgtgcagactgggggaaagagagattctcctaccagtgttggagcaaaaaacaaatcctcagtggtcattttgggtttggcgactgaagaggagaaatgctgagaacactgggagcaggcgggggcacacttcctccctggaaccccgctgaatggcagctcatggtggccttggatgccagggttcctccttcgaagtggctcctctgtggcccttctgtagcccctccagctcagacctggttgtagttgagaagcccaaggagaagttgtaaataggttttgcaatggcaatggtgagcttaatttttcattgaccttacctccagctaataacgaatcggggggcgctctttcactcacagaagcaaaaaggaaaagaaagggcttcctagtgacgagataatttgtcagaaagttatgagtgggcacggcagggctgtataggaagtgtgtattgaacaatacgacacactggcttctaattgctgctgcctttctgatcaataatacatgttttcaaaaagccttctgcttgcatttacacaatggactgtaactactgcaaagatccattaaggcctattttaaaaagcgcattcgtaaaaagttgtctaaatctgcattacaaggcagattatgaaactgccttgggagatgttttgtctaaaaagcattcagcctgtatctgctggacagctgactcgagcttccactctccacgttgcttggagccaggatgccttctccagaggatgcaccaagcaaggcaccggcaggcctgaggtcctgtccacagaccagccggcctctgagcccctcgggctggggctgccttatgtgagccaatcccccaggagcctgggtggccgcagacattaatcaacccaccactcccgaatgtgtaattcaaggtcagataagtggtcctctgcggcaaataggactctggggacccaggtccctccagcactgagaaggcttctggttgcatggggagggctcaaagcctgtggccaagccaggatgcagaagacaggtgtgtgctctagcaagccagtctcgttgaccaccagccccacacagcacacaggtgcgtgctgtcacctgtgcaggtgggaagcccggactgtttgggtccagggccccctggctttctatgccaccctagcaccatccagtgactgcttgggcctcatggcctcagctcctacagctgacaggacagaggctgatgacagcggcagctcgtgctgatggccagcgtccctgggctaaggactctgtgcagactgactgtctgcatccccggggaacttggggagaaggagctctgccttcccactgaggcacggagactctgggtaacccgccaaggacatggggacaagagacagagcgcagacacactcagagccccctgcagccttcccaccatgctactgccccaggccacacctagacagccccctgtaggagagaaaaccctggcagaggggcaggaaacactgccactgtctgctgagcccactgatgcatcattgggctttaccctcaaggcagtgcccatgttattgctctcatgtcacagaggatgacaccgaggcccagagaggaccacagaagctgctgagtggtgtggctagcctggctctggtgctgagcgaaaaggatggagattcctccaagggaaggggaggagaagacgggcagaggggaaagaagaaaggagggcgagggaaggaaattcacaagagaacaaagtgtggggacatggaaaactgaagtgggcaaagtgataatgataggttagtgggagtaggtgggcaggctggtgggaggaggtgggctttctctgaaccccccagggtctctgatggatatgtaggcccctgttgcttttgttcgggcacccggctcctaatcaggccccagggaggatgcaaaaggggtcttctcccaggccaggttgagggctcttctgcaaacacccctgagggcacctgaggcccacaggcaggcaggacctgcacagttaggtaaagcctgtcctgcacagccacaccctgcaggcccaggccaggtgttctgtgagcatgctcatggaagcagcatatttggcatagggtgggctggctgagcagcccctctgagtgccctgagagctagctggtggtcactggcttcctcctcgcagctgccctggagggcaccaacagcaaggccagggaggcaaaccgtggggagcagtagacctgcccctcacctcaatagcccgatgggggagcagagggcagtggcagacagatgggaaactgaggcaccgaccactttgctaacagtgcacacagccagcctcagagtctgtgcttccaaccaccatgtcacactgcccatgggagggacctggacccctgcccacgcccactctgagaggcctcggtcagcagttccaggaatgccacccagccttccagtatcaccaggaccgagctgcgctcttgaatgtgtttccccctacctgcaagtcacgaggcacccccagagccagagtttcctgtcactgcactcagcctcactccaaccatgcttctcagtgcaggcagagacccccatgtcacctgggtcagaggacacagagcatcccgcccgcctcccgccaggcaaacctgcacaggcatggcccagatctctgtccatgatgggtttccctcctccctcccttccctgtgctgcgttttggtgctttggggtcagacctgaggtgctccaggtaatcttcacctgctcagaagcaatgaatgacctccaagttctcacatgctacaggaagatggtgtgagccgcctgcccactgagcatcttaccctgcactggggcagagccttgaaaataccatctcctcacagtcaccagggaaggacactgtttcagtccccatttgagagatgacaaaactgaagctgaggagtaatgtatgcaatgtcacacaactatgaatggcaaaattcaaactcaggtctaatcactccaagcagatgcctgcaccagaacctcttggggaatttttttttttttcttagagatagcgtctcactgtgctgcccaggctggtctcgaactcctggcctcaagtgatcttcttgccttggcctcccaaagtactgggattacaggtgtgagcccttagcctggcccctgaactttttttttaacatggatttttagggagtgggggacccaggatgtgtgtcttcataaaagctgccctgaagattctccaaggggacctgcgggcagggacaggaagcactgaccacactgtgatgtgccctcctccagctcccagagagcccgcgaccctcagcagggcagtgtggccagggtgcccgagcccaggcccaggaaggcccaatggctacaacttattaagggcttcctgtttgtcgggcactgggctctaccctcacatgcacccctctttctagtttcaccccttcttctgaaagggagatgtttatagctggggaaactgaggctcagagagatgactaaggggagtcaagaaagagaggcagagccccctgcaggccctccccaccccatggactgagagaagccagggccaggactcctgggcagccaaagaccggcacgtctgctttgcacttcacctggcccccacctccccttgtgagacctcagggggtggcctcgcttcccctctgctgggcaaggagctccttcctgctgcctgatgttctggatactgagcctacacccaggcagggctgaatctcctttccccgcagtccctgaggccagcaggctctgggcctcacaactgtcctctgctgagcgaccctttggtcagatccctgggcgtgcacgtagcagggaggtatgcatctgtgtgcgtgtgtgtccacgtatgggaacacaggtgtatgcatgtatgcatgtgtacagggtacacccatgtgagggccccccagacctttttccaaggagtaaatgacaccctctcatagtgtcaggtgttcactcaggacccccaagggtgagggtggagcgagagcgtggaaaggcctaaggtaggctaggcaggagcacagccccagatggccccttaagatggccacacagagcccagccagacatcaatgtcagccaagggctggccagggtggtccccgggaggtgcaggggtggggctatttaagcctacccacttctctcttcattcacctaggaggcaatcacaggagcttgtctgtagccaaaagatgcccccagcccctccctacctatcaggtcccttccctgggcacaggcctgagtgtgtagcctaggtagccactggcaccagagatggaacctgtctgaacccaagggagccccttgtggccaactctagctccataaactggaagggtgtggcaggcagccggagtccagtggcccacagtgtctctcctgggctggcaggcctgtgccccggccacctgcccctcagcaagccaggtctggacatcacggttggctgagtgcaagccagcctctgtcttggcagctccccctcctgcctgtgagggtgacttcactttgacttcatatctgcagtgatgtgcagatcacttattcagccctgagctcagccaggcaagagggcggggttctgcacacagcaagcaagggagcggctggctcaagggtgccctgggcccaggttccctggcttttcctcctcaagggcccatgggcttcccttcttccatccctctgcgcctaagtgcaggccagacctcaaaaagcagccggggatggggcgagaacagaggacttccccactgagcccacatccaacctcacccagaaccccttctcaggtccagttgctgctccctattaggggtaaatgtgtttatgcgcatcatttccatcatttctttgggggaaaattggattctttcctcctcctcgctactcgctctccgactctgccagcccatctcctgagagttctcctgtgtaagggatgcaagggccaccagcaccaggtctctgaaaggacgccggagccagtttccggtttccaagggttggaccagtgctggaggggggaatcacaaactgcccttccaggaccctaccctctctactaccccaggatgctgaaaaaggctattctgcctctcttcccctgctcagctcttccccgcctcctgcctccggccccagcagaggccgcgctcccactgcgcctctcgcctctgagaaatggcgcagcaagcgctccgcggagagcctggaggcggggcgcccttctctgagtccgcggggtcgcaccccgagccagtcggccagacctgcatcccgcgtagcatccctgccctctctgtgcagcggaaagggcaaaaggcagggactgcaagcgggcgcgcaccgggtaggaagagcggctctgcgtaggtgcgcggacccgggctcctgggttccatccccgccgcgcacctcggggtccgcacccggctcctgccgggcccttttcggccgcaccccgctcccgcaccccgctcctccccaagccccacccggcccaagccgcgcgtcccgcactgagctcctacacgcgccgcgccccggccgcaccccgcgcagccagagcaagcactggagccccgccccttcccgcaccccacccgcctccggccccgcctggcccacccctggaccgcccccgccccgccccgcccctacccgctcctccggcgcagccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaaggtgagttctgccggccgccggctcccgcaggggccagggcgaagttggcgccgagcagcggagcgggcgcgttcagaagcgcctttctgtttgccgtgggcagcgggctgtgcggtcgccggccacccggcctcggctgggagcgcagtggctgcggcgggcggcgggcgaagggcaggacgcctcgggccgggcgcctcgggccggggctgggcgggtctcgggcgggagcggagcgcgggccgggccgcgggggtcggtgctcagaaccctagccatagccgcaggtctcaatctggccgcgccctgcgccaaagccgcgtcctggagcaaacgggacagccgtttcggggccgacctggcggacgggtcagggagccccgaaagcccgcgattcgtgcggagagttctgtttcggcaggagacggctccgtcctggtttccttttcccgctcagcgtccgtgcgttcctcccccagctctgccgtcctggccagccgagggattcggaggctcttttgaaaagattgcttttccctcgtgcgtttttgccgccctgtctttaaacacctaaaaaccgtggtttctggggtggctccccccgaggggccgccgtgataggcgtcccacccggcagccctggagtcgtgtggcgctgcctggcagagatgctgaagatgcggccataggaggcccagggcttggggtggggcaggggtttgcgccgccagccagcgttggtgctgggcctggtgaaacctcaggtgccttaggatcccagcattaggtgtggccttgcaaagatggtcatcgaccccacccaaactctggcagagtgagccgcaaggctgtggaatctttgaccccttggcacgcgtttaagtgtccctcaaactggccctgacttgatcccctccaagcgcttgtgtatgaaccaagtttccctctaagagggaaggagccctggccatcctccctcactccttacaaagggctttctctccccacagcctttgggaacagaagaagccatggtcagtcaccctgtctctggccccaggccctgcacaaactgagtttccaggcctgcctgagacttcatttgtgtgacctgcgcctcagctcagcatatgctgaggccagagcgggtccccagtccacctagcgagggacaggggagaagcccttgcctttctatcttttctgagtgttaggactttggggtcccagtgctgcagggggaagacacggggcagaagcaaacaaggcgctctgacgctgtcttgggattctgggctgtggctttggctttgaggttgtgggcagggggccaggtgtgaactgctgctggtgtgctgggcagaggacttccccacacccttccacagccttgcgttcagttggggtggccagtgaggctgtgggggccaggctctgggggccggcttgtggcactcagcaggcatgcaggtagctttccgtgcccagacccctggcccacagacagcttcccgaatccagagatggtgagcccctagcccctgggataacccggacaccacagttggaggcactgggagtgaagaggcagccccactccctggagtagacagctggggcctttgaagaggctgcagagctctttcccaggagccacagctccggaggttcgagccgcactcttggagctgccaaggaccgccccagtgagcccctcggtgctccccaaccaccccaaggggacagctcggcctcaagcgccctcttgcggacgctgcactttagtggctgggcctgatgacaggcacagactgggtctctagaggatgagggttcttccacagctcacacatgcacactcacactggatcaccaagacacactcctgccccttctcacagcacttgctgccaaggctgtggacatgcacagcgtggttccttcacaccctgcctcacccacgtccacacagggaccccagcccctctcatcactcatacacacagggacgccacgtgtgtatatagggacacacactcctcatacctgcagggcatagcctgtcagccccaggtatgctggaaccagagtgagagaacctccatctaaaagttacattcatttaaaagttgctcttaaaggtttctggcatttcattgctcaacacagatacagctgtccccgttgcttggatgaggaaactgagtctcagcttctggggttccccccaggtcccaggctgaccctgcacctcaacctcccacagctcctcagcaagcctcttgtctcttgtcttcctggcctgacttcttgggtcctgttttgcagcaaggaaggacattccctctctgcccctgggccccggggccttctgttcccagcatggaagagctgggcactgtgacttggcagggcccggatccaagctgccagaccaccctctgcagagggcctaggcagcccacccctgcctgaagcaccaggtatcagcgcgggcagctcaggccaggggtacagctccccctgcttcatccttttccttctcccctttctctggccagaggcttcaccaggttcacctgggcctggcttgcttcctcctccactccagctcactaaccctgtctggcctccagaagctgcctgcagccctcactggtgggctgtgcctgctgggggcctgcaagcagagagcaaatggggaagtgcattgagctgattcactaaattgcctttcttctgcagaatcactttagggacaggctgaggaaatcactgtttccttggtggtgtgaagaaaatgggatgcgatcacctagcggggagctaatagccttttagccagtggaggagaaaaccaattaaaaattatgatatctgttaaaatggaacctggggtgccaaggggaagggaaggcccggaagctgccatctcccctgagaccttccccctctgcagcctggccgaagaccctctaggtcccctcgtcttaactggataaggctaataccagcagtagcaccccatgggggctcacagtgcactgcccctgtgctgtgcctactcacttcatcttttccaacaagtctgcaagggtcatggtcttggcccatttcacaggtgaggaaacaggttctcatagcctatggactcgaaccggtagagaggatgcgggagctccccagccctggccctctggcttgctccagcccgttctctgggccagtggtgtgggtccagggtggggctaaggagggcttccagggaggttgccctgagcctgcccacccactggtgagtccccccacctcgggctccaggtgccctcaggacatcccagcccagatcccagagtaatgtgtggcaccatgcacagacgctgagatactctctgggtctcgtcagctttagttgatgtctgggagtcctatgggtctggggaggagcaccaggcatggctgtgccagcagaagggccgactgtgtgtgctctgtggatggcaggaaggcatcttgctgccagtggcggtgcagatgttcggctgggacaccaggctgtggcccttgcagccaacatatgcctgaggccctggcatcggatggaagctactgctctgaagacaagggtgcagggatggggtttgggcatcagggatgggggtacagctgtgtttcctcatgcaggacagggccttcctcctcatttttcccatcctccaggacagcctgggagaagaaagccagggaataggggcaaagcagggtgcagccccccatgctccctgctgccctcctcccctcctgcagaggcacttcctttccacttcaggagcccctcccccagaagtgggccccccccatccccccttccttctttggaggctgcttcctggtgccaggttatgctccctccccgttctctgctgtgccctctatctccccactcctctgcaattatttttcagcagagtgacttaatagtaacaataacagtaacaataatagtaacaacagcaggctgggagcactcctgagggagcctcggctcctgccctgctgctctagggctggggactctccagagctgtctcatggcagggagagaccgtagtcaaggagaccctgtgtagggacttccgcatgcgtgtgtggcaaggggcggggactgggcagtgaccaccaggcagggagcacacctcagtcatggtcacagagaaggtgatgatggcaccagggctgtctctccgtgcccgtctgcacctgggcctgccagagccgtcttctgtgccccatggggtaggggagcaccccatggcccctgggaggctgccagtcagtgggactatgaggtcaaatggggaggtcccttggggtccatgacccaggcactgcaccccttggggctggaaggggagaaggccccaggcccaccagagcccctctggctcccccactagaacagcagccagggccggctcagggattgaggcgaagccttggtgcttgattctttgtcccctgaggcaggctgtacctctcataggagaactttggaggacgggccttctcctgaccaaggctctgggacacttggcagcccctgaggtcctgctttacctctctgctttctccccccttctctgagctctggggccaggcctgggcacttggattggcgctgagacaatgaggcctgaacctccatggagctctggtcccgcagctgtgtgatcatgggggcctcagggaccccgctcccctccattccccaagcctagaggccatgaagcctgtgggtccctgaactgtccaccctgagactgcaggcagggcagggctgggcaagagcaggcagcaagctgtccttgttcccacagctcctcctggctgggctcttggcccctgaaaagcctggggcagggagatggtgccagcaggaccttaaggacagcagttcaggtcgcacctggccctggagggagcaggtggccagctccaagcaaacacctctgtttgcttttgcctcaaggagtggctccacaaagtgtagcagcccaggcaccaccacagaaaggtcaccgctgcacctggacaggtgtgcgcctacctggtggaccagcgggcataggctttcctccctgatatcagggatacctggagggcctggtgctggggctctgtgctcaggggagaacctgtggccctacagccccaggttctagaccccctcccagattcgggtgctgcagctgcgcttccactcctggcccttgctcctctgtgctgctgctctccatgccctgcaggagccagggttccaaggaagcacctgaggggcagtgtggccccagggcaggagcaggacagtggccaccaagctgtttccagttcccttgtgtgcctgtgactccagaggattctcgcccttgtgttcctgagagggaaaaaggaaacatgtatttcctagaatttaagtaatgactggggagatgtgtgctctgggtgccgggacgagggtgggtgagctggaggtgcagcatgagctggtgcagttctggagggagggagagggctcattgggtttcttcctcatactacttggcagtgcaactggcacagacccggcagctgttgctgggctaggggccaggggcttcctcttgctctgttccccttcctgctccaccaccattgcctgtagggcgtctgccagccccaggaagcctaacacttagcccaagtggggctctgggcctggccctcctcacccagggaaacaacggggctcatgggcgcttggtgacatgggcacattgctctgccatcgtaaggggccagcctggctatgggacccagcaccggtgggcagcccacaggttgtctctgcaggagactcctctggcaggtcacatacaggatgccccacagcaccttgaaaactcgtgacccgggaaagcctcaaattgtctttgctcccctagcctccccaccacctgtatatgcaggggcatgtgagactgtacttggtgacaggaatgccccccagtctcaggggcttaacgccatctactatgtccttcttgtggcatagcctggcatggcccttacccactgggtggccacacctcccagcccttgtgcctggctatgtgcacaggagggcacagagcttcaagaagcctgaggcttaaggagctttgaggcctgggagggggccaccgtcactttccctgtgttccgtgggatcctgtcacatggtcgttctcaccccaggaggcttcaagtacagaggacgcggggatgggggcacgcaggggtgtacctgcacacacttctgcctaccagctctccatcccttgtcctggtccacatagcaggggctcctggcgggcccagcagctgagggggacagagggggaaacagggtagcaaataattatggtttactcttttttaattgtgaaatttgtgtaacataagtttaaccatttataagtgaaccatttggtggcatttagcacatttacagcattgaacaggcattgccttagttccaaaaaatttgcatcaccccaaaaggaaaccccatacccattaaacagctgcttcctgtccccgggcaacccccagcctgcgttctgtctctgcggcttggcctgtcctggaacatttcatctgcatggactgttgtctggcttcactcagcataaggtcttcagggttcctctaggctgtggcacacatcagccccttcctgtgaggggtaaatagtgtgccgtcacccattcatctggggatggacacgtgggtgctttccaccttttggcagttatgaaaaatgctgccagggacattcctgttataaatacctgagttcgtgctttcagttcttttgggtacatacctggacatgaaatcgctaggtaattctgttttatattttgtggagccgccaaactgttttccacagtggttgaattgtgttacattcccaagggttacaatctatccacattctcaccaccacgcattattctctgttattctctggttcatgtctcactctggccgtgcagccagtgcacagtgctagctcgttgtggctttggtttgcctttccccggtgatggcgtgctgggcatcttttcctgtgcatgctggccagttgcatgtctctttggagaagcatctcttcgagccctctgcctgttgtctaactagatggctgtcttgccatacagctgactttgctgttgcatctgcatcaagagctgcagagaagcagctttatccagggccgtcactgtcagtgattgagccccaggtcccttgtgaggagagtgtggattcgtctgattcctcacatgggcattgaatcaccactgccctcgaggaccttgaggacattctcggaagacctggactctgaggccacgttgagcaccaacatctggaaaccatggtgtcactgcttgtgcataagaaggggcctctcaggaaccgccctgtgaaggatggaggaaggggaaggtgcaaggagccagcagacccccaccccactgacaagacgagactcagcagcaggggaaccagggccgccctctctcgctcatcctgaaccctgactctaaaaataaccaggctgataatcggatccgctgtaagttgattatcatcattgccgtggtgtgatgtcatgctgccaggccctggggcagttttctcaggacagcggtggatgcacctaggcagctctggaggccagcatggagctggggggccctgaaccgagggtggcaggcagcctctgtgggctcctgcaaatctgcttggtgggggtggaacactggcatccataggcaggcactctgtgctcccaaggaggagttcctgtccccattcgcagctagggacagagccagggaagccaagtgcccagccctggcaaacagcggggaagcacaggggcatgggctgggccgctctgccctgcgtttctgctccttcctgctgctgaactctctcctttctgctgctgaactctctcctttggactaggcctttgtcttcttgcctcatcgtcagtggcctgggaggacacttgcagtcttaatcctgttttggccccatgtccctcaccccccaggggccacctaggccagagcctgtcctgatttccatctcggccaccgtctgcccctcggcccctggtcaggagctcattctgtggatactcctgcatagacatcacgtggactcaaagggcatgaggacctcggctgagaggagcttacacatcagtgcaaacctctcattttacacagggagaaatcgaggccctgagggaggcgtgagttgtcacacatgggggtagtgtcagatgaagacttggcaccacttccctgggcatccccttccctgcatggcatccccagccttgggtttggattcttcttcacccttgatgttgaggtctttgctcccaggacctggataacagcatccagatgcaggtggtgcccccgcatcgggctgcctggctgtgacctggggcatcaggattgtcagcttgtctggccccaggtctgtgctgggctgaaacctactgtctcagaggctcctggctctctccctctgctctccactgctcttaagagcagaccctcaagccttttttgtgtcctctctccagggagagcccagcttctactctgcagcccaatgcagaaggggtggtagctcacggtgcctcggcttctctgcatgcctgtcactgaacagagaagcccaggccagactgcagcttaattcctagcctctgtgtggcctccagcagggtacctaagctagtgctgcctcattttcctcctgtgtgagatgggaatcctcatggtccctacctctgacagttgttttgatgcagtgggtgatgcagatgaagcgcccggagcagacctgctcatgaggagcacaccgtggattcctactggttaatgttgaacagggatgagaaggggctggggtagggcgaaaatgggcaagaccatctcagcttgaggaacatgagctgacagattgacttaaatttgcacatggacatgatctgagtcactgccttgctgagtgcatggggacagttgcccaggccagaggcaccagggtcaaagccagtggtgatgccctggccccgttgccccaggccagggccagtgaacaatgtaatcagctggggcagactctacagccctgcagccaagggggccagtgacccttacatggtcatccacaggccacttgggtggccagtcctgttcagccaggccttgccctaggaaagaaattaattataacctaattggcagtttcctttgcatagaagccggaagcaactgccagtgaggctggtgattaactctgcagcagctgggaaattgcagttgggcaggagcgcccatcatcctggccaggccgctgcagctggtctgggtatggaagtgtgggtggtggccatcgtgcagcttagggcctgggcccctcagagcagaaggctgggtctgtgtgcagaaggtagccttgggctgccaggtcccccagtgcccagttgcggacctccttctcccaaacctcagccatgcctggaccccttccccactcacggcagaaggctgcatggcttttaggggtgtcaggaggctcatgtcctggttgcagttctaccatgggtgtgcagcgggaattctgggcttctgttttctggcatgggatggggtgaatgatatctctgttctacagcaggggctcagactggatgtgtgagaagagcctcagttaaggagggccatgttcgtgcgtgcagggatcgtggtgcctcccaggccagggccgggccccatctctcctcctcctcagctgctcttccagctactggccaccctgcctggctggaggtccaagaggagaggtatctgaggagatcctgcactccacaccgggtctcctgcccagcattttggaagaaccaattcttaagtctggtactgaggccgcactgccatgatgataactggtgtcaccaggacaccagggaaggagctgcccttggtgtttactgagcgcccggtatatgcactgagctgtccatcatctgcagagaccagtgttttcttgatggttttacagagagatgcttaaacccagtgaactaagaatgggacaggctgtcagatttttctcaaaggaggtattgacttgttagcgggtacaattaggccgaggaaccaggggctgatgcagtgtgctcccgaagaggggcttctatggactccagttaccagagcctgccccaggattttccttcacacctgctctttatgccagggatcaagcagggttataaatacaacagcgggcaggatgagccagtggtggccctgtgggtcttcacagcccaaatttccttccatggttagtgtaggttaaacctggcaaaaagctgctttcatttggaagtctcaggatgccagcaaagtgatgagagtggtagggatagaggtgagatgggggtggtgctggtgatagtgatggtcatggtgttggtgttggtgttggtagtggtggtattggtgatggtgatagtggaggtcgtgatgatggttgtggtggaggtgatggtaatgttgatggtggaagtcatgatagtgagtggtggttgtggtggtggtggtggtgatggtgaagacggtggtggtggacgtgatagggatattgatggtggagctcataatggtgaaggtggtgatggtggtggaggcagttgtggtggtgatggtgctggtggaggcaacggtgatggtggtggtgatggtgaagacggtggtgggaatggtggtggtggaggcaatggtggtggtgatggtggtggtggaggccatggtattagtgaaggtgatggtgaaggtggtggtggaggtcatgatggtgaaggtggggatggtggtggtagaggcagtggttgtgatggtggtgatggaggcggtggtgttagtggaggtgatggtgatggtggtggtggaagtcatgatggtgaaggtggggatggtggtggtggaggcagtggtagtagtggaggtgatggtgctggtggtagtggtgaggcagtggcggggaaggtggaggtaatggtagtggtagaggtgacggtgatgttgatggtcgtgatgcagccatcttctgtgagcatttgcttggtgccagccactgatctgtgaacttcatgtgcattaattccttctagctcccaacactcctgtgtggtgggagctctgagtctcagtgggtacagaggagaaactgagatacaaatatatgtcccttgctccaggctcattaccactgcaacacacactttctctccatcacccagatggagtccacagccttgcctggaatccacaagcttgcccaaccttcttcttcttcctaagttcatgccctcatggcccgaggagctggcctcctgtctccaaccagcattcacctccggccctgtgctgttgctgctcatctgaactgcctctacctcctgctgcttttcccctcctttcactctggctctgcccccagccctcccgtcctgccgggcactggctcctgcttgtggctgcagcccagagcagtcccttccctttagcctccacttgcctgtctgtggctgtctcttggtcaggcattttttcagaacgggcagcgtggggcagcccccttggcccctcagcctgggctaggcactctcctccatccagtgctgggccctttaaacaggtcaggcagcgtccgctcagcagaagcgtgtgatgacttccccagccggctgacctcagggagggtgcacatgggtgcccccagtcagctctcctgacgtccctgccggggtcaggtgtcccagggtctccagccttagggtctaacacattcatctctccaaaagtaaggattccttgccagggaaagggctaacaagctgcctgttttcttggccagcaggcatcctccccatgagcccagggctatgggtgaccagcaagccattagcatatgcgtgtccatctgtcctgcctggctggtgggctgccaggatagccgttccttttgctgcccaaggaagtactcaggacccagttactgtcacctctcccaaggcgtgcaggtggcgtaggaagtgcatgtccgttctttctgtaggacacacctcaggaccccaggggacattgtcaagaggcagaaccagggtgctcctgctgtgtaccagggccgacagcattgtgtcggggagcccgcccccacatgcaaggacacaccacacacagggaggcgtggagcacatgtggcctgtcccacctgctaacaggccggccatcggggccctcctctggctcataggcagggcatctggaggaagccgtccctgccaagagcaggttgagtgtatgggcactgtctgtcagcctcatactcttgttatcatcagacaagaaccctgagagttaagggaggcaaaggccagcaaggtcaggacttggggcagagatcggggctgggacaggagcttgttcaggacagtgggcaggactcccacaggtggagaggacagggatggccatgcacctgggagccctgggccaggctgagcgagcgagcaccagggcccggagtgaggggctgatggcaggggcatgcaggcagctgcacataccaggctctgtgtatgaaagggaaactggacatgtgtgagtaggcccaggcctggcaaatggctcagagagacacctgtgaacagctgtgtttggtggctgccctgggcaggggtgaggctgagagcccactgaacctcctgagtcagaggtgatgagagccacccccaggtgcagggaagacacagggaatttaggaagagagcaggacgccaggcagggtgcacttaatcgtcacttggaaaccagtgtccagtagtggctgcccgggagcctcttgggttggcactgggctcgtgtgaggaggaggcgtggcaaagggaagggctctgtgacagaaggcagttgagactgggccgcttctgggcgctgcctcctctgctgaggcctcagatgggtccctgccttgctcagggctgtgtgctccatgctaagccttgtcctcctgggggctcaggcacaaccaggtgactctcaagccagggccacatgcgtgcaccatgggcccctcccacatccaaaagcaaaattatattctgcaactgtgttggtataagacaaacacaatccaggccactttattattatttatttcttattatatttatttcatccttttgattttaaaatgaattaaaacaaaaaccttttttgcgcacccaggcgcatgcagcagtggtgccggtcaggagcagaggttcctcctctgcaggctcctggccccctgggaccctggcaccgagggctggccctagcggcccagcccttgtgagccctcacacctgcctagagatggcgcgctccctagccagtcagggcgctctcgtgcctggatgctgtggtctcatgagtggacagcagctgaagtgggaactgcagcagatactggccgtgcccaggtgtgtacctgccccaggcaggtgaccagggcagcagggtgatgccagatggggccaaaaatttcatgcttctgtttgaccttggttctagctgaagatttagctgtgtacacatctttaaaactgggatccccctataaaaaccagatgcacaggcagccgaagaaagaatggatgaattgggctacatcaaaatgtaaaacttctgtgaaccaaggccacaatcagaagagtgaaaacacagcccatggaatgggagaaaaacttgtaattcatagatctgatcagtgttaatccagaatctgtagagaactcctcacactcaacaacagcaacaaaaaaacctgattccaaaatgagcacagggggccaggtgcggtggctcactcctgtaatcctagcacttggggaggctcacgcaggcagatcacttgaggtcaggagttcgaaagcagcctagccaacatggtgaaaccttgtctctactaaaaatacaaaaaaattagccaggcgtggtggcaggtggctgtaatcccagctacttgggaggctgaggcaggagaatcgcttgaactcaggagacagaggttgcagttagccgagatcgtgccactgcactccagcctgggtgacagagtgagactccatacaaaaaaaaaaaaaaacccaacaacaacaacaaaaaaaatgagcacagggcctggatggacatttctccgaataagatttacagatggccccaagaagcacatgaaaagattctcagcattgccactcattagagaaatacaaatcaaaatcaccatgtgataccatctcacacccatttggatgtctactatcaaaaaaaaaaaaaaaaaaaaagaaccagtgttggtaaggatgtgaagaaactgaacccttgcgcactgctggaaggtaaatagtgtagctgctgtggagaacagcaggaaggctcctcaaaggttaaacctagagctgacttcggctccagcacctccactctggatacatacaggaaaggaagcaggaagcagtcaggatatatttgtatgtccccattttcagcagcattattcatagtaaccacaaagaggaagttacccaagtgtccattgaccaatgaatggataagcaaaatataatacagacatacaatggaatattacttggctttaaaaaggaaaaaaaatttgccacatcctatgccatggttgaacctcgagggcattatgtcacagaaggacaagcactgtatgattccacttacatgaggtccctgcagtcgtcaaattcgtggagacagtagaatggaggattccaggaactgggagaggagaggagggggagtaattgtctcatgggtacagaatttcagttttacaggataaaaagagtgctgtggaaggatggtttgcatggcagtgtgaatgcacttaatgccactgaattgtacacttaaaaattttaagatgataaagttcatgtgtattttaccacaatttaaaataactttttaaaactagaatctctctttatatacacctccaaatttgttatttacagtagagcctcccttgatccgtgttttttccctaaatgcaaagttagattatagtcccaggcaaaagcagcctccagctgggacagagccgaggacccaggtttgtgcagcatgctgcaggtggtcctacccgagtgagtctggctggcagctccggtgcccagggctcctcaggcactgatagatcatttcctgagctgaaaaggagtggttttgtcctcagcctcaggcttgtttgctcagcacagtggctggccccacaaggttgctggtgcactagtgggcactgcacgtgtgcacagggcgcatccacacagctctatcctgccactgacagcctgcccgtggctccagtgcccgtgagaccatgtcacagtatctccccgtcctcttactcccttccccttcccaaattctgaccatttcccaaatgtgcccagccctttcacactcctgtttatgaaaccattgtactggctcgttgattcattgattcattcattggttcataaatttattcattcagctcacagaaagtgagttggcagatgtggcaggaaggtaggcaccctgtaagagtgaggaggaagtgagttggagggcagagggggccctgggagccctgatgaggagctatgttttattctgcaagcagcggacagttaacacagggctccacagagggtgccatgattcagtggaccctggctcctctgtgcgagattgcctgtcctgcccagcatgtggtccagggttggacaggggtggcagaggggacttgggaggtggggtgaggggtgaaagagaaagggatctggggactgaggtgtgtgacctgagcagtgaggtggggccataccgtgatgagatggggaagagttggggacaatttggggtgaggaggggccaaactgaggcaaaggagtagagagagcaaggcatggagatgcccaggctgctgatcagcatgctgcacaccagcatagagacaggattaacagcccagggcctggatatggctggtgagtgagccactgccaccatctggaggacagggtgcagaggaggaaaccagccgagggggtgagcagcctcggtagcatcccagcgacgctggacagcaccaaagacagaggaggtcctgggagcagctgggagaaagtgggttacccaggaggggccggcctgagcatgggccctcagcagcagcagtgaggctgaaagacgggagccagaccttatgtagagtggaggaaaatagctgtccacatggaattctccacccagcaaaaatgggccttccatgaatgacgtcaaaaaatgaggcaagaagaaggccaggcgcaggctcctgctggtgggggtgggacacagtggcaggtggggaggcgggaggagcagcagtgtggccaagcatccagttcagcagggccacgggctccagggtgtttgttcagcataaatgttctgtgaaatgtattcgttgtacatgtcaaatatttgactatagtaagagaaaacgtgagtgggaagtgggagggaagcggtgggggggtgggggtggggtaacaggtcacatcctgagaggataacagtgctcagcatggggctggagggacccccatagggacagctggcctggggaggcggggaccgcctctttccacccccagcccccagggaggagccctggggcctgtttcccattcccaggaagatgattgcattaggaaatcgtctcttaaggagattctgctgggccataataaagctgtcatctgcatcgtctgccacccatcaagggcaggcgtggggctggtgtcgcatgaggggttctgcaggaagggcctgctctacacacatgccctacgctgcttctaattcatgcagtttttggatcatatcgttgttattgttttcttttttggaagtcccaaatttcggcccttgtgctgccatcctagggaagtttttcatggtctggagctccatttgtgtttctgtggcagggtcaccatgccatggcaagggtgacctcacagtgccccatcagagctgccgggtggtcggcagtgggggagtgagagaccaagggccacagccaggagccagtggagagctggtgagcccctgcctccacagacagggccaggccacgcttagtatgtgtgcaccgagggtgcaggaaaatgtgtgtgcttgtgtgtgaaagcgggtatataccagtatgagcaaatacatgtgcttgttagagccctattggcagtgtgagaatgtgtgagcatatgggagaacaagtgtataacagtgtgtgcccccgtggtgtgtaatggtatgcgtctgagagaatgagtgtgtgtgagagaaggaatgcatgtgtgcaatgtgtccgcctgagtctgaccaggagacagccccacgtggtccctgagacaggagcagtaacatcagaggcactaagctgtgatgaaagagggatgaatgggggtggggagagctctgtggggcaccctcagctgcaggtgggcaccagggaaggaaccccttcccagctggggtcagagcctgagggaggagctggatgctaggctggggctgctgtgcaggctcaggtctggcaggaactatccttagggcacgggagctgaggctgggggctgcaggaagctgatggctaggctcaggtatgggctgcatcagtgccgagggattgcatgctttgggtatgtgctagggtggagcacatagcacaccctgtctcgtggactgcccgggcagcaggacctagaaaaggcaggtgtaacaaccggagacaggagcaacccctggcctgtcccagcatctctccaaagccctccaccgatgaagcttggccttgtgctgcctgcaaagtaacctgctccaggcccgcctgggcatgagaacatgcacacctggacggagtgtgtggattgacaaggtgtgtgcacgcgcacatgtgggacgagggggctcaggactggtcccctctgcatccaaagatgaataatttaaacagcccagccacgtgtggaacattggaaacagtctagcacttcactctgtcaaacactagggcagactctttcctgctgagctgggcagggtgggagcagatggggtcttaggtgggcatgcctccatctctttttctgtctcctgcatgccctgtgcgtgcatacatatacacacactcatgacacacactacataggccttgaaggtttctgaggtctctctgaatgtgagcagcaacttgggtctttggcaagtgtgctgtgagcaagcaggaccttcccccaccccatcctgcatggtgcctgggcacagccagcctgaggaaccagaaccacggtggcgggggtcattgagggttgatgtgggaatcctcttagtttctcagacaagcgacactgccatttgcaccgtcggtgggtgtggtgtgtgccaggccaccgctgtgctgcagaagtacagggtgggcccagccctggcaaccaaagctgtccaggcagacacctgtgtgctaggtttgagggaggattctgtcaccacgtggcatttgggctttgaaggcatggggtgggaaaagctttgtaagtcctgctggtgaccttcccatggtgccaggagtgggagtgtctgtcaccagacgtgggtctcgacccacgggcctggccttggtccacaggccaggcggcccttctaggcagaaaggcggcagcaggatgggaagccaaccagcagggcactgggcctcctggcaggctcagcacctgctggcgcctggcttccaccatcactttcttagctgttatcctaacccccgagacacaaagcctcacagcatgtccagctatttcacttggtcaggcttctcgccacccagccttgctgttcttatatgtgaaatgggcagtgaagggatctgcacccagtggctgagtctgcagtgagagcctcatgatgatacacccctgtgcagaggtgcacgcctggctgcacctgcactggccgttcctcctctccttagcatgcctcccccacttcgaagctggggaaactgaggcccagaggaggccagtgttctgcagagtctgcacagtccggtggttcctgatgccagcagctgttccccagctctcccctgtggctgacccaccacgattggctgcatcatttgtgggccccttgatctagaattatgaagaatttcaagactgtagcaaagagcattaaaccaagcgtgagacctctgagcagggcccactgggactgcccaggctgcagtccgctgaggcaggtcctgcacccacctccttcattctcccaccttggaccatgtgtttttccatctagaagtgtctgtgacaagcgggaaccttaagacagctgtgcccagctgcagagaccacctgggaggcattttaagtgcatttaagtctgtttctgctcgcaatcattgcctgacccacaaatcccttttggcagcagggagaccaattgggattgggccccccacgatcctgtaggggtgggctctgccagatgggagcaggaaggcccgttctcccctgcacatgtgggctttgtggtgggggctttgggaagcccaggcctgtcctacctctagtccctggaccactaaaggtgcttgcacatcatggaggccccagaggagcacctgtgggattcccagactggatctgctcctgcgacagatggggtgccagggccctacccactcttctgcagcctgggcatcaccagagccaccccacggccacccaagggcaaatggttcttattgggaagaccagggccagaggtgtgtgtcccagagaaaactagacccagctgagctgcattgcctctccccacctgagctcagccaacccctagcatcctctctggggtaagaacatggaccccactgcctgcatggatagcccagacataggatgccacatgggattgggagggggctcatcggggccagggcatctggaccctcctcgccctgtgaggccactatgagttacaatctctcaccctctgtcgccagaaatgcagcaccccctcccaccccgagggcactgtcatgggagcagtgttcctgatgtacagtgagcacttcaagagaagctttctcctgttctattttcccactgtgggactccagacgtctcacctgttctcttccaggctccccttggcacttgattgtttcccccaggtgtgtcctggaggagcccagcggccctgggggcgttctcaactgctgctgcaggccccgccctccagacccctcagcgacctcaagcagcaaccgtctgggtgggagcaaactgatcaaaaagagagatcgattacatacaagtgcagtattcctaatgtgtcctttggatgttggtattgtttgggcattctagagtctatttgcaggttcttaatggattttaagcattttttgcctatttatccatctttttaaaaattcatacgattttttattgtggaaaaatatacacaaaaatgatttacaatgtaactatttttaagtatacatttcagggacattaagtacattcacattgttgtacagccatcaccacctccgtccctgaacttttcatcttcccaaacttaaactctgtccctatcaaacactaactccccatcctgtctcccccaagccctagcaatcaccatcctatgttgtgtctgtgaatttgactactctagggatctcacataagtggaatcgtgcagtgttcatccttttgcaatgggcttatttcacttagcataatgtgctcaagggttatcagtgttatagcctgtgtcaggattttcctcctttttttttttttttttttgagacaggtcttgttctgttgtccaggctggagtgcaatggcacaatctcggctcactacaacctccgcctcgtgggttcaagccattctcctggcttagcctctcaagtagctgagattataggcgcccgccttcatgcccagctaatttttgtatttttagtagagacggggtttcaccatgttggctaggctgatcttaaactcccgaccttaagtgatctgcccacctaggcctccgaaagtattaggattacaggcgtgagccactgcgcccggccagatttccctcctttctaagactgaatattccattgtatgtatagaccatgttttgttcatccattcatccattgatggccactgaggttgcttccaccttttgtctatcgtgaatagtgctgttgtgaacatgggtgtgtaaatatctatttgagacttggctttcaattcttttgcgtatgtacccagaagtgggattggtagatcatatggtaattcaatttttaagtttttgggaactaccttcttgtttttcatgataactgtatattattttccattttcaccgacaatgtacatgagttccaaaaactattttaaaagctttccactgtgggaaatgttggccacacacagtcagcagcatagtgcaccgtgcccctgcttgggctcactcagccacagccgaggctagcatcctgccttcttcaaggaagctacgcctctgtccacagcgccttcagtgattcatttttcagttatttaggtaaaaattacatagataggccgggcacggtggctcatacctgtaatcccagcactttgggaggcagaggcgggcggatcgccggaggttgagagttcgagaccagcctgaccaacatggagaaaccccatctctactaagaaaatacaaaattagctgggcatggtggtgcatgcctgtaatcccagctactggggaggctgaggcaggagaatcgcttgaacccgggaggtggaagttgtggtgagccaagattgcaccattgcattccagcctaggcaacaagagcaaaactccatctcaaaaataaataaataaataaataaataaataaataaataaataaataaaaattacatagataagatgcacggaccttagctgcacaatactgacaaacgaatatgcccacgtgatctgcacccttctcaggatatgggaccttcacattccccagaaagtgccctgtggcccttcccaatctgtccacctcccccacacccccgcctgccacaggcagccagtctgatccattgcctaacatccgtccagaatcatgccatgtgcgctcttctctgcctggcttcctcaccttggcatggtttgtgtgtgtgacccatccaggtgtttgcgtgtatccatagttcatccttttccattgctgggcaggattctgtggcatggctggaccacggtgtgcctgtccatccacctgctgaagggcctctaggctcttgacttctgtgaatcatccttccatttccaactatggcatttgatagacgtatgttttcacttttcttggatgaatggagtggaattgcagggtcatatggtaggcgtatgtttagataaagatttatgactttcctgtaaagtgctttcttcattttttggcaactgttgcctgccccacatgggtggcagtgtctcctgcccttgaacactctggctctgggtgacctgttgagaagtctgtatggttcaggtgcccttccggcttggatgattgagaataggcttgtcactgaggatactgcttcccctgtttccttttctttttctgttttaaagcagttcttttctagcccgtgtgtaactatacaaataattgagtgttcatgttctcaggaacagagatgaaaaactcctgctaagatcggaattttaaattaatgattttttttttttttgtccttgaagaagccttattctcaccatccctcactcacttccctacttcccacagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcagtaagggagccgccccaacacccaccccgtgccccaccccaccccttcctcaagccgcccttatcacagccgctgacactgaagcttggcatggcttcccccccaccgctggtgtggaaggcgtcaggggttaagtgaggctggcctgcctctgtgtccagcctggagagaagccaggacaagcttcagggctgcgtgaggctgtaggagtttggagacacacgggaatcatccgggtacactcttctgccagacccgaatccctcttccagtggggctaaaaaggattaggaggtttcgagagagggagtaagtggggctggaaaaatcccaaggttttgatttagcaaatgacctgcaactctctggagaagcggcagttcccaaggaaagcctgacttcttatcagcagctggctgcccttgtacctggcagggacttgggcctgtcccaggtgtccagggaggaaagaggagcagtcagagccagagtcacggccacatgtgacattggtaatgggaggggtgggggggaagcagagcccctgtgacaggaaacggtgatgctgcacctggtagctcccatccctagcacccctccagggccacagcttgcacagccctcacaaccaccctgagccctgtctgctggtgagaggcaagcctcaggctatgaatgcagagcaggcatccctgccctacccaggcctatctgccagggacagccagggtgcaggggagggaggagacttgggtgggcaactccctccggcgcagcccaggcagttcctggaggaggcagcatctgaggttggtcgtggttctacgcacttagttgctgccctcttcatcctgagcctccagggtggagcttgaggaatgggagtccctgggtgggggccagtgtggaatttgccctgggcctgcatttcgtaggaggcctaagccctccaaggtggggagaggcttcatgcacagccagttcctgtggaggaagaaaccacagggtaatttaacagggagagtttgtgtaaagaattaattacaacaggggattggagcaatgagggacaggctagcaaaaagcaaagagaatgccagagaatatgggaagagcagctctgaggagcagccgcccacctagggctgagatggaggctgggaaagccctcgcagcccagctgaaatggctatggcgcttcggtgatggaacttgccggaaatgccccctctaggcattggggaagtatgtctgcggccactccaaacctcctgaggagggtgtggcagggggggtgctggtcaccccttactggagaagttgccaccatcagagttggggagccttagacccagtgctcaacacacctccctgaggaaggggcctctaagccaagaactgaatgatgagagctaggcctgtggggcattggtgctgggcagcagggctgtgcagcagaggtaaggaggtggcaggcagagctggaacaccagtctgagccttgtggaccttggtggggaccagggtttacaccagccctggagctcctgcctcctccccattcccgactgcctggcagatgtggccgatgcccccacagacctgacttctctctgcagaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagtgccgaccttgtggggccgccccacagtgcctgctactgctggtcttgctctgcgagcccttgacacaagccatctggtttattcttcaccttcatgccatcagttcattcaatattccagaagtacctcttgcatgcctgccaggggccaggtactgttctaggagctaaggatataacaatgaacacaacgggttggaatcttgcctgcctgcagctttcattcttgtggggcagacagagcgtctgagcatgccaaggaaatcaggtggcttctggaaggagctagctggggaggaaactgggaagagggaaacgctgaagaggaggggaacagacgaggagacctccattcctctatcgtaaattgggtggtcagggtgggggctagcagagcaaaggtgggagggtgccgggtaggcaggcctagccccttggagggcaccacagtgtgaccctcgtgtgcctggagtgcactgagcgacagggaagagctgaggctgatggggcagaatagttcctggggcagggggcaggtctgggagtggcttgcagggctttctccggaggaacatggggagctatggaagactttggagggagggagtgctggcaggacctgacttagttttaaaaggattagtcagactactgtgttaggaatggtttggggtgggaaggttcaggggcgaagctgggagacaatcagaaggctacaggagaaacctctgaacaggaggatgtggggtgtgatgccgggatacgggtggaagccgaggcatggcgagaagcaggcagctgcagccagtcagagggtgggatgagctggatcccagtggagaggggagaaggcagctgactaggtgcagggaggccccatttgaccatcagaaagtcaggaagtggggctcaaccaggtcacagaggctgcaccgctggcaagtgtgtcctaaattcacactaactttatcacacaaacatggcaagaatattaaaatctcagtaaaggaagacaagccatcacttatgcttccccagattcctttcattctctggggcagggttgatggagcacttggttttttgcatgctgccctttttcactaaaaattatgtgattaaatttagtttagtggggggttttttgtaatcacactcaacagaggaaagcattatatgataagcatttcccacatacgtaattcatgcgcaaggcatggttctgcctgggaggcttgtggagttgcccccgcctccttggggtgggttgtggggtcttcagcggtgaccttccgccttcagcatgcccccttttctggattatttctggaggacaaatccgaggtcaggctcgttgaagactgtgttgtggttcctggccctgcttcaggggcgatgtagtctagcgcgagctgccatgcagggcacggagcattcgcttttgtctcgacatccggccttcagaggatgaccagcctggcgacgcactggacaaggaggtgtagagtggggatgcacactaggcggtcggaaatcattatgcgttaatgtcacatcataccccagatgtccactgtgtttgttttcaagtggtagaatcgtggctttctcacgttctctaaaatgaacacatattgcttccataattgaaaaaaaaaaaaacctaacagtttttaaaaagcagccaaggtcaccaatatggtgaaaggccgtccctactaaaaatacaaaaattagccgggcatggtggcgggcgcctgtagtcccagctactcgggaggctgaggcaggagaatcgcctgaacccgggagttggaggttgcagtgagccaagatcgcgccactgcactccagcctgggcaacacagcgagactccatcaaaaacaaaaaaaaagcagccaaggccagtagctggctctctagggctgcagtgcagcttgggctgaggcaaagccacccttccccacacaaggccactcctgatcaaggccaggtgggcggaggggtgtcccagtccctactggttgatcagggtgcctggtcctggctcttcccaaccagcacgagtgaggacgcagctgcagcaggacgtaagcacagtcatcgctgcaaactgcaaactcgtaagcacagtcatcgctgcaaactgcaaactcgtgctccgagcgctgccctcccctgtggagcggaggaggggaggcctggggccgcggcggtgtgcgccccgctctgaccgcagagcccccttcccgaggaaagcggctggcccggtcccggctggtgatcacgcggggcccctgtctgcttggtgcgcaggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggtgcttgtccgcgcgtgctgtggtctacccagtgtctgtctccggccacagttcgtttctcggtcggtttagtgtccgtgtagccacccaaccgtgtggccgaccattcgcgctttcatttgtccttcgcctccgtctgcgccgtctgtcctagggggaggggaagggggagtcctgccagcacccagctgggccttgcctcgggaggcaaggaccaggacgaggcccgagggctcgcgtctggggcatacttgtgccgctgcaggcgggcgcggcgcgctgcccgggcggggagcatctgccgggagggcactccctcccaccagcagttagcccccaacgggagggcccttgagtgaccacgagcagagccggggattggagaaggacgggaaggcggatcacctccggcgccgcccgccccgcccttctccggctcgcgctggtggagcgcgaccgccacctgctgggcctcggccttcctgcagccggcccacccagcaggggccgtgggagagtgggcgtggggactgaggtaggtagtacgttgccttgttccgcttctctgggcacaccacgtgcaggtttggcagggaaagggggtctggtcgaaagcacaatttgtgagtaaaggctatgtgggcctccctggggtgacagcagaggcctggtgggcagagccatccaggtgcccagcggctttcctcacaaccccctccagcctggggtaggaggatgcttggaacagagcgctctgatgtacacctggcctcggagctcggctctgccggctgttcctgtgtgaccttgacctgaccttcaccctgtggggcccagcttcctcaggggagagtggaggtgctcatcctgctctctggggacctggatgggacctgccagcagggtgcctgggcatcggctgtaattctccttataagaggtctgcattgtacctgttacacaggcgaggctcagtggctcagggaaggtgacggccaggctggccagtgaccccgtgggaacttgaacccaggtcagactgtccccagacctggctctgacaacacacatctggtccacctatgggctgtgtgggacgtgcagcattctaaggtctctggttttggggggtctgaggggcccatctcgcctgcactgaccaacgccctctgcatcctgcaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactatagtaagaggggctggtggcacggcctggctaggcccccaggaaatgaggtgctcgctcttcatgggcaagcagcaccctacacacatgcacacctggcatggccctctgtggcccaagccacttcccctccaccctctgcccagcacttcctgtgtctctgccaggcctgccctccagccaccagcagggctttcaccatgggacctctctccctgagctgatccatggccgaccctggcagggccccaccacacccccctgctgacctcaccagggctcaccaccgactgcaaacacacatgtcacctgaggctttcctccagcccctggcactccatcgttgcccctaaggcgtcccaagtgcttacggattattgctccagcctcagcagctctctgctaaacaggctggtgtacagaagcagccccgagccaggtcagggcttctgagcccattatcctgcctgactgctgacatgccaccatgctcacctgcttgcagggcacctttcagcagcggccttgcttcctgcctccctccgccacctcctgcagatttctcctgggatcgccttccaaataaaccacctgcatttggggtctgtgtctggtggaaccccaggccatgagtccttcacccctttctgcctggcctggtcctgttcattcctcagtcctccccacctcaccaagcctatggaggccccacttgtcagaggggagacagcctccttgccctggcactgaacaccctgtgtgccagagtgcccctcccatcattgtttccaccacatgagatccacagtggcagcacgcggcaggtacaccgatggcatgacttccagggcttggcctgcggggtcattgggtctgctggaggttcctgcagtggagggtagttctgccatgctctgggggagctgtctggagggctctagtgtgtccttcccagggccttggtaatgtagacctttaaccccccatgcctcacacacacacacacacacacacacacacacacacacacacaccctgttacccaaaaaacgaaactctgtaaaacattttaaagaggtttattctgagccaggatgagtgaccacagcctggagaaaacacaaacccaagaagccttgagtaagtggtccccaggtccaaggtggtggagttacagtttgcttttatacattttagggagacaggagttacaagcaaggacataaatcaacacacagaaggtatacattggtttggccccaaaatgcagggtatcttaaaacaggggcttacaggttagaggtagatgcagagattctttaatttacagttggttgaaagagttaagctttgcctaaagacttcaggtcagtacaaaggaatgttaaggaggcctgctatgtgtcgcctgatgctatacagggtcaggagggaaagtaaaccacgttatacctgggtaacttaaaaaaaaaaggtttttaacaagattttatggaccaggcatagtggctcacgcctgtaatcccagcactttagggagaccgaggcgggtggattgtttgagtccaggagttcgagaccagcctaggcaacatggtgaaaccctgtctctacaaaaaaaaaaaaaatacaaaaaattagccaggcgtggtggcacatgcctggattccaggaacctgggaggctgaggtgggaggatggctggagcctgggaggtcaaggctgcaatgagatgcaacagagcaagactctgtctcaaaaaagaaaaccaatgttatggtttgtagggtgtttcttaacccttgcctggcatggccttaggtcctgtttataatttggtatcttactgccacaaagagtccgatctgtcagtcttatgatctctgttttaatgttaatgccggtcagttgtgtccaaactccagcaggaagagggcctaataaggcaagtccaccctgccttcctgtcatggcccagaattctgtttttaaggtttttctggtgtcccttggccaagaggggatctattcagttggtccggggactcaagattttagtttcagtttacaactctatacacaaacaccccatacacacaggcaccaataccctatgcacagacaccacacaaatgcatactacacacttacacataccacacacacgcataccatgcaagcatatcatacacacagacaccccatacaatgcgtacacatgcacacacacacaggctgcctcaaattgagaagggttccttggactttcagttcagtaaatcccaacgtttgaacattggtgctaacttaggaccagccccaggcctgttgcatggcactgtatgtgtgaaagtgcgtgtttgcaccagtgtgagtgcagggctgtgtctgggaagaggtgtgctacacatgaggaagcagccagagcagcttggtggtcattgttgtgcccctacctgcagggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccaggtgagcccatacctattgcctgtctggggaagattgaaaggccaagggacatgggggcacagggaggcaggtgacactgcctcttggcccaaccagcacagagtagactgggtggagtcctgagcccagggccaggaggtacagctgtgtgcacagaagaggcctgggagagctcacagtgggcagggctgggggctccttgggcctctctttttttcccctttccattcttggtatctttaaaatgtattttcaaaaatgcaagagcaatactgggtaaatctgcatatggtgactcggaagaatcttcctggtggattggtgagagtggcttgcagagatgttggtcccacgtgactccctttgtgcaaaagcagatcttccctgacagggatctgcaagtgtgcagagatcacagtgctgtccacagtggtgccctcagggggaggcaggaaacgcttccactttttactttttgtaactaggtttgctagaaagcgtatatttatatttgtctttggaaaataatgattagaaatagaaggcataaaagtaataaatattcattaaagaagatgaggcatgaggcatgaggcgtgatcccttctacccataggcgccagtgttgcacatcgtggtgttctttctgggatgtttctcgtaagcacttattaagttgacttgaaactgcagcacgcatgttctcgcatgccgctctcccttgcagagcagcccgtggcgcctcctcttcaggggccatctgccagttctttcgggtggttctgtgcccgcatcagctcctggcagccacccgtgtccagcccacgagggagcccacccttggacatatctaagctccccgaccacctccttggcctttaatgggagtgggatcagagacagaggggcgacaagacagagggccccggggggtctcatggggggcggggcaagagcaggcattgctgaagttgggtcacctgccctctgtcaggagcaacgggggcctgaatcccagtccagcctcagcctcactgtggtctcacctttctccccagtttgtaaagctgtgaattagggacaggaaccctgaacaattttgagagtcacatgagcatttggaagtgggctttgtaggggaaagtgaggaggcccaggaggctggtttttgctgtggtcacttgtgggcctgggagagcccagccctgctctggcccgcccccatctcgccatctgtggaacttttggtttcaagcagctgcaagagttgccaagaggttgaaagaattcagctgcctgactccaggtcctggcatccccaggagaggcccctctttcccaggggctctggtcaaagtcccagagcctggcatccccaggagaagaggctcctctttcccagaggctctgctcaaagtcccagggaggccccctggtcctgcatgggctggggcaaccatgctcccgagtcttgtggctggggttcagtgctctgaccaggggacaccagggcagggtggacctctaaaccctgtgcactgagggaggagtgaggggtccccagagcactgctggggcagctgggagcagccagggaggagcctgggagacattccggcggctttgttgtctgagtgagggaggaaaggggagtaaagggttgagtcagggcctgcctggggcttttcctgccaccaaactgaacctcgaggccctgggttgccttgacctccagctcccaggaacaggggcagctggtaacatgtggcctgagtggaacggggcagggcagggctggggcaggtgggtgggtatgaaggctctgaggggtggaggacagggtgctcgggggggctgctgtctccaggcccagttgggggctgttccaggacttaggctgtgtgggaatctctaccctcaggccattacaggccggtccagctgcctggctaaggtgttcccctgtgcccccctagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatgtgagtgcctgctccagggagggagggtcggggtcctgggggcttctggagcctgggcctcctgccctttgagaaaagcagtacagctgcaaggcttagctggggagtggggaaggcatggaccagcttcaccctgagtgacccagcagtaaatggttgctccttccagataacatacaggaccttgggtaaatttgaattttgggtaaacaacaagcagttttttggtataggtgtgttccatgcaacttttgcagcttctcgaaagacacacctctaggtccatccatgccctcttaggaacatgctgacacagctgccattcatgccattcattgtgtatctgaaatgtaggtcccacagggcgtcgttggctgaatctggctgcactcacatccttcctcctgtacttaccccagcccaggtgacccctgctttgtgaccatgatgtcctgtaccctgccctgcgccctgtgctcctggcactgtctttgctgccctgggtctgtcactccggtccccttgggctccatccgtgggcagctcagctggtgctgttccctgtccttgggcactagctggacgctgggcccaggccagccccctgtgaccctgcttgtctgccacctgcagatgtggccgaggaggcgggctgccccctgtcctgtgcagtcagcaagagacggctggagtgtgaggagtgtggcggcctgggctccccaacaggcaggtgtgagtggaggcaaggagatggcaaaggtaagccctggaaacgcccaagggaggcctgcaggggcgatggcaccggtggaaacggggtcctggggccctgccagcctggggtggctctccctgctccaggtctgcttctggcacctcatcccccatgtggctctcgatgccagcatagcgggcagcagtgcagggcttgggagagggcttgtgagtacagtgaatggtccccaggccggattcactctggacttgggaaggtctgaaccaaagttgggatgtgctggggacagaatggcgtttttctgggaggtcctcggccaggggatgtggtgtgggcaggggactcattgtctgcatcagccagaggccagcctgggtgtgcccaccaccatgaggggccctcaccatgcagccctgagagggtcccggcctctttgctgtaagggccacctgtgtgaggaaccccccatacctcctctcccataagccatggctccccaggatgcttccgctggcaaggctctgtatatggtgtttccctactcaggcctccagttgctcctccctagaggggcaggatctgcctaggaggtggtgggggcgtgtggcggggctcccacatgggtgacagcctgctgtgtgtcctgtgcagggatcaccaggaacttctccacctgctctcccagcaccaagacctgccccgacggccactgcgatgttgtggagacccaagacatcaacatttgccctcaggactgcctccgtaagcagggtttaatcagggcatgggaacaggtaggagatagtaggggaaacctggatcccacaggcacttcagccagagttgccagggctgtcagttctatgcatcaagctgagcctcctgtgcatttcagcatcaccctagccatggggagggagcaggcagggtcagggacagggggaaggcagggacccacagactgtccaggcccctgctgaggtcccagaagtcggcacacacagatttcagaagcagagaatggtcagtagggacactgacagggaaagtgcggccctgagccagacgagggacactgcaatgtgcgggtcaggccaccaggctccagttttggaggcagagtcctttgttcagatgaaatgttaggagggggcctggcttcacccatggcttcagaaaggcactgtgaccaagccctgcccggctaagccaagctgctgggcccctggcctcactgggcctatgcttgcgacaccagttggggagggggctccttgggacactgccctggaaatatgggcgcctggggtggtcaggcgccccaggaggctgagtgggctacgtctgccctcagggggcagcattgttgggggacacgagcctggggagccccgggggattaaagctggctatggcacctgcaactgcttccctgaggaggagaagtgcttctgcgagcccgaagacatccagggtgagtgggtggcggccgggaccaccaccacctcccagccccacagaggtctcaacagcacatctgaggtcccaacaagggaggaaattgctgggaggcgagtgggccccatgaaacttccctccctccctctgggcctctgttactccacccaggagaggggccagggcccctgtaaagtgtcttctggccataagttctatgatggacaggccagaaaagcagttcttccaccaaacaacttgtcagcctgacaagtcactgtccctgtgaccatgcagctgggacccacccaggaacacatttcaaggtcagcaggtatggtgggttgcacagccacactgactacactcaggggtgctgttctgcctgagcatagggacacgtttctgtcattgagttttctggtattatatagccctacgtccctagccacttagcattttcataaagaaaatgccaaagacatttggaacagaggaaaattttgacctcccctgccagccctccagtgccagctggtgtaatgagcacagcctctgctgtgtgaccttggcaggctgctcagcctctctgagcctctgtctccatctgtaagagggcaatagtggtctaggagggggcagtaaatggcagtacccatgctcgatggggtgttctcaggccttcccacacctccatggccacttcccagctggcgcggacacggcaggctggagagccatgaggcagagcatacgcagcctgtacccagtggtgccgagcctctggcggtgccaagcctcacaccacccccacccacagatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggtgagggtccctgcggggcagggaagatcccctgccctccccagctgccttccagggagggaggccagctggggagacagaggccatcctgtgaggggctgccaacgctgggcagacgaggcctgtgttctgcccccatttccatagggcgctgtgtggggacagtctgtggggtgggactgtgatgaggtgccgttcccatctaggtgagaggcagtggtcagggtcacagcatcgggcaggggagcagcagtgtggatggaggggcactgaagtcagaagggggtgcctttctggggagcctggcctgcaggtctgcatgtgctactcagagcctccaggctgtgccgagtatcctggagcctccttgtcccggccaggcaggcctctgccctctcctggtggtggcctgccccttcagtgttcctactagcactgtccagggcgctggaagccaagcccagttctggaagtaacagaggctcagagccaagggtgtgagtgaacggtgagccacgcagcttatggtggcgtgaatagctcctcggcaggagcctccagggaggaagctgagcacccagtggccacagggccctggcagttcccatctcaggctgggaggtggcctgggattcctgggaggggccatatcccacagtgcagctcagcctgaggcctcggccctggagcctccgttcaggcaacacccagccctcggtaagggtgtgagccaaggaggccttcccagatgtggccactgccgcttccccaccagctttcctaattggtggtccccatcctggcctggctgcagcttagcctcatggcagggctctaggatgagccaccagagtccttcataaacccagtgggtttgtgtgaggctgcccaggaaggccgcactggtctgggctgctgctggcagagaccaccaccctaaccccagtcagctccagagtcacactcatcagcaccaggtcttggacccatgactcaacctcagtatttgagaggatcaggttgatgtcgccctcatgtgcttattgcagtctctagagtgtggtaaacaggtttccagtgccagctgtggaggtgacagcggcagggaagccatggcagtgtcgacactgaccttgactgtgggttcccagggaatgtggggccagaccaggacagcccaggagcaggagacctggggtgacggatgcccagagctggcacatcaagggagggttcctggatcatggcaggctttggcctccctggtcagagttcaagtactgggggccagggtgggggtctgggaaggcatccggagcagtcccaagtgggcccaatgtgtggatagaactttggtgggagggcagggtggtagtgccagcaggcagggtgagcgggtgcgtgagggccagtggcagcccttgaggagcagtgcttccacactctgaggcggaacatggtggcgcctttctttgcaggggtggctatgtagagaagttgtcctggacacttccactgtagtcagaggtcctgggctgggcctggtgctcatttagtcctggggcaggggtcaggggagacagtagaccaggaaccagagagggtcgaagtactgagtccaagccatgctgtgaccacacctgtcatgtagcagctttcaggggcctggctgtggggtcctgcccagggcagagacaggcagcgttgccgctggctcagatgacagccggttctctgcacattggaacttgtccatggggcctcctttaagggtcttgccttcttcctcccctgtcatcctcacacttttcccccctcttctcccccttccctcatttccaacataggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaaggtacctgccaggcacaggcacagtgcccctgggggagtctccggggcggggggcgggtgaggcccctcctgcccagcatgggaccctgaagagcccccaatgctgttctagagcggctgcagttgggggacccctaccatgggccacttgggcctagagaagcagagcgaggactttgctctccctggaaggctctagaggtgttgctgtgccagtgccactgaagatctaagctttaaacatttaaaaagccctttgattttgagctgacagctgtcttcactccagtctgccccattcattcctctcagcccagtgtctcctggggtcttggtgaagagaccaccagtaaggactggccctcaatctcaagagacccccatgggcctgtctggcctgcatgcccagtcatgccacaagtttggctctcgatgggcacatgcacctacccacacaggcatgcgactgcactgagtagccccctcttctgtggccaggccccagccctgtgaacagccaggctgaatggcggtgagggagagtggttggtgtacataacaattatctgcagtagtcgggggctgcacagcacagggtgcttccagatgcctacccagccccagactgggttcacctccaagccagtaaaaccccggactctccaggggcacagggagacccttggatttccattgcagccatgcacagccccaggctgcccacacctggtccaaggggtcctggggccccaactcccaactgtcctctcccttccagacaacctttcaggacagaggaggtggcacggcacagctgggcagtgggacagctgacctgggagggatggcttagccatgtgttctgactcttggaataccttcaggcccaggcacctgctgggcattccagcacagctctggccaccatcgggacgcatgtgctgggcaggtgatccctgtggtgcctcgtcctgtttccatcatgcctctacagttagactctctggggaatcatgctattcattaagaataagccagaatgtcaggtgtgcagtgcactggtaacactgctttatctcaggtgctaatgtgggtcttcttggtaactaacggagtgtgagctgctgacgtgtgtgtgacggatacatcagcagcacaggagatgcctgggctccaggctggccatctcagacaggagcgggaaatggggagcctggtcgcggtgtgtggacctcctttatggctctccaccttctccagggcctctcccgacaagtgggtgtgtgggtacccctcacctttccagaatgattaatgcggggaatttctgtggacgactgtcttctaaagacaatgactacaggaacataatgccacatacacaggtggcccagccctgggacactctggggaaagatccggcatgtgtggttgctggctcctcagggtgcttcttcctcagggtggatgaggcccctgtccactgatcccaaaggctgggagaagcctcaagcagcatcgtctttgcaggcctctctgtctgaacttgggcaaggcgatgcaggtccatcctgacctggtatggtcatggaaggggcttccaggagcgatcgtttgcaacctgctctgtgctgcatttcagagaacgcctccccgagtgagctgcgagacctgctgtcagagttcaacgtcctgaagcaggtcaaccacccacatgtcatcaaattgtatggggcctgcagccaggatggtaaggccagctgcagggtgaggtgggcagccactgcacccaggctgggggctccatacagccctgttctccctctttctccctttccctactgctcctgccctgtttcctgttctccctctttctggaagcctggctcaggccccagcctggagcttgtgtctagctgagtccacgggctgagtggtcactttccatcagaggggccccgcgctagcggcactccctgggcccacagggctactcagaggtctctggtgtgacactgccatgtgtcctcacccagttcggggctgggcccgtggggcagggagctctaggaatggacagtgcatcctgggtactagggtaccctgggtaccacagggcaccaggtgtgctgtgacctcaggtgaccccagccccgccctgcatggcaggaacattgtcaccatttctcagataaagacccaggagaccagcctggtttgttggttttccaaaccaccatgctgctcaggggcttcccagcatgcgtgtgtgggtgtgtgcgagagggatagggaacccaaacaccgggagtgcgcagcaggcactgtggtcggcaccagtagagttggaggctgggcctgggacaggacaggtgggaacagggagcaggctgtgtgcagagcccagcgccaggcaggaacccttgcatctgcgcaggcctctgcctccatcagcatccccagcctgcactggggcaggacccaggaggcaaaaaggcttggcgtcctagcatcagggaggggtgcctcccagggcagtgtcgcctgcctcaggcacctcgagaaggaggcacccacacgagcagcaggaggcagagagcaagtggttcaagagaaagctgaggcttcaaggtctgcgctctccacagagctgcagcagtgctgcctgaggcagggctgtgtccacccccttactcattgggtggccgggcctggggaccctgcggcctcccacccctggctcctggaagacccaagctgcctgacccgcacgcccagggccccctctctccgcccccaggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaaggtgcgtgcatatggctctgcacccagccagccccggccaggccacaccctgacccaccacgcccctgccacccacaccctggcctgccactcccccaccatgccacactctagcccaccatgcccctgccatggcatgccatgctatggctcaccacgcccctgccatgtcacaccctgactccaccacgcccctgccatgccacacccccggcccaggtctcaccaggccgctacccgggccacacaccacccctctgctggtcacaccaggctgagccagtgaccgctgctgcctggccatggcctgacgactcgtgctatttttcctcacagctcgttcatcgggacttggcagccagaaacatcctggtagctgaggggcggaagatgaagatttcggatttcggcttgtcccgagatgtttatgaagaggattcctacgtgaagaggagccaggtgcccagtcccggggatgaggcggggctcccagggatcccaggtgcaccatggggcaggcagtgcccttgggaagcctaggaaagataccgaagattagtggagctctaagctttttatagccctcaccccaaatctttctgaccctgggtccccaaggacccaattagaactccgctcagcctctgccatgtccttctcctccagggcctccagggcacccctccctggcagcatactgacccgaggcccttgccgcacttttcagaggccacctcatgctgcggaactaacagtcctcttctgcagaataaaggtcaccgttctgatatgaccttagctcttttctcaaagaagggtgggatgaaattagcaggatcgtcattctttgcaaaaaggaatgaactgctttacaagtgaggcttctcccgcacaggggccttggacactgggctgggtgagtttagaggcataggaaccccctggacaggatccagaaacgcagcccagctttgtccaagtctatgaaacaggcagtgggcacccttggggacacctggttccctaccatggtcctagtcccgggacaactgccttggccctcttagtttttctgcccatgtcagcccctctcctgcagcctcccagtggcagcccaggcagggcaagttcaaggggctgctcaaaggccatgccgcccagacgttcagagcagaccctgctcaaaaaagaagaagaagaaaaaaaaaaaccacaaaaggcgacttcctatgattcagctttgctctgaggggtctggagaagccatttgtgttgccaggggttgtgagctgttccgtttcttctggggtttcccttgtgacagcagatctcagaactgctgtggggggaagtggtaggggctggcccctgccctgtggagggtgtggacagagccttcctgttgatgcactggtcctccagggagagaagctgaaggcattcttatacaagacgtgcaggctacactgtcacacactgctgccaagacagccacactgcactaaggacataaatccctcatgtgtttaagtaaaagaagtgacagtaagattgtgttccaacccaaggcacacattttaaaaatggacttgcaccttcaggcttgtctgtggagaagctgtttctcaagtcaccctggaaaggatttgttaggtcagaccccagcactgatgagggatgtagggggctgggggcactcattcagagatgctaaaagcaccctgcaatacaataagagagaaaaaacagcctcccccaaggcacacagacaaatcccttccctcaaggctccttcagtgtggtagctgctggcaaagtgcccaacatggaaatgctagatgttggtttcccaaacacattggccctcagaaccccaggggagatcttgcagggggagttccaggcccatgcatagggaagcactgctctgcactaccagcaggcctgtggcatgtgacaagctggccctgtgtgcctgtgggtgggcagctgactcccgccagcatctcagcaatccacaggaggttcaggctggagctccagccccttcaaagatgtgtgtggccagttctgtgcccaggagtgtctacagcactcctctggttactgaaagctcagggatagggcctggccttctcctttacccctccttcctagagagttagagtaacttcaatgtctttattccatcttctctttagggtcggattccagttaaatggatggcaattgaatccctttttgatcatatctacaccacgcaaagtgatgtgtaagtgtgggtgttgctctcttggggtggaggttacagaaacacccttatacatgtagtggggccacgacgcccgtctgtgcagcttggccagggaattgcactggccctgagcacctgtctgcagtgctagccctctgcaatgaccccctcactgaggggccttcatgatgtgttcgtgaggcaaatggctgggccaggccgggctgcagttctgaaagctccggtagagcatgagagccgagcaggtggccagtaacccagcctcccccacccttgctagtcccatgcctccctctgggtcccttggtgactcaggcccagcccagcagttaccctcctgtggtcctgagtagggctttgggctcaggcagagcacccagtgacttgcccccacccacaagtggagcttggggactccacctgaagatggccttgtgtgagtttatagattggtgtgccccaaactgctcaaaggtggaagccaaaatctcattcttccaggtccaatgacaagagctgatcacttttaaaacacaggattcttgcctctaaagtgttctacagtcagcagaggtgtgatgtgcctctctttttttgtggggggaggggatagggtctcactctgtcacccaggttggagtgcagtggcgcaatcctggctcactgcaacctccacctcctgggttcaagcgattcctgtgcctcagcctcctgagtagctgggattacaggcacgtgctacttcgcctggctcatttttttgtattttttggtagggacagggtttcaccatgttggtcacactggtcttgaatcctgacctcaaatgatccacccacctcagcctcccaaagtgctgggattacaggcgagagccaccacgcctggccaacatgtgcatcttaaatactgtgggctgtgaataagcaattggacaacagctttccgattatataagctgactgtaggctagttggaaaaggcagagaaaagcataaagaagagactgaatgtcattggaccacaccgcccagtgacctctggctgccctctggtgtgctccgtggtgtgcacatgtatgctttttattgccctaaatgggctcatgcgatgctgttttgtgatatgattttgttcccattgcaaagcgagttttccttcacagttaaaatgtttttctatagctttttttccttctaagattttatgaaattttccaagcacatagaaatggcaaaagaactatacaaggcactctgagtctggtggcctgcattctcaccgctttaagtgtgagaatcttaagaattattaagattaattcatgatattaattaatgtatcattaattcattaatcatgaattcatcttaagcctcatgtgtcccttgtgcgtgtggctgctctgatgggagtggcttgggcaaggacttcagcttcatggagtaggggccaggcaggcaggcagcccttccccaccttcatgctacatccatctgagcagccagacccaggctgacatctgtgagcatctgtgcttgaagccgacagggtcagcaggtgcttggtggtgggggtggatatctgggccccccggagggctctgtgagggccaggtggagccactcactggtcctttcactctctgcagatggtcttttggtgtcctgctgtgggagatcgtgaccctagggggaaacccctatcctgggattcctcctgagcggctcttcaaccttctgaagaccggccaccggatggagaggccagacaactgcagcgaggagatgtgagcggggactggctttggcccagcctcacttgggaagggaggggacatctgtgtgcattccctccccatccagagcagccccaggagaaaccaggagaagtggggggtggggagtgggcagggcagaggttagagagccatccttgggtgtggcagtagatgctgggggtcctaccccactgagggctggtgggcttcctagggggtcttataaaaatgagtgagagcagagactggtgcaatgcaagctcaagggctgagagctgtcccagcaggacacttagggaggagaaggtaattccagatggcccagggggcacgtgttaaggggtgcctgagtggaggtgcagagccaggcaggggcagcctgggctgcaacctgagaggttgaaacctttacactctcaggggagatggtcttagaaaccaggctgagaacagatgagaaagggctgcccagaggcagagatgcatggtacatgcattccacagagtgtgcacactgctggggcgtggagggggcatgctgggccgagaagccaggtaccacctccctgggcccccagctggtggccagctggagcgctgtggtctgcctgggcacccaggcaagcaaggacggtgcaggacagacgtgtgattgccaaaggttcttgtttgtctgtctccacacctaaaagccctcaatcaattcattcttcttgagagttttaaggactggcacttctcacttagctgccagagcaagcatagtatccagtgagctgtttaccagtgtctttgcaagggaagtaaaaatgaatctcccttggagggaagggaagcttgtaggattctggaccacagctctgagagacctgagcacagtggcccacgggctgggatcctgcaacaggccatgccccagtcccacgaggctcagagatgtcagcgatgcagaaatagctttggagttggagacagagcacactgggcccagggtacagggcagggtgcgatggctgtggtgggctgtccttctgagacctggccctgcttggatcatattggcctgtctgctcttcccaccaggtaccgcctgatgctgcaatgctggaagcaggagccggacaaaaggccggtgtttgcggacatcagcaaagacctggagaagatgatggttaagaggagagtgagtgcctgggtccaattcccacaagctgaaagtggcttggggagactccagcctcaccccagggcagtagttttagccctcagagttcccagtgtggggccacagtgggattgtgcagagagagagagtcatgctctcccctgcatgcagacagcagattgaacccttctcaggccaggccgcttgggcttcttttcaagtcatgaagaaaccaagattcttgacatttaggaaaagctctctacagacaggcatgggaggaaaatattccaaagccaaaaagaaatagttttccataatggaaaatgagaaagttgagttaaagcaagtgcccaaaattcagatgcccagaggggggtccggctggaggagggcagtgagtaaggagcagtggagactgtggcaaacagccagccccctccaaagggttccttgctggagtacctgtggcctgcagaaaaaggagccaggaatgggctgggtcttctgaattttatgaggtttatgttgtctcccagtttttattgttaacaattcatttaaatttcccagagccgaacgcaggccaaacaaagcatatcggggggtggccagagtcagcctgtgtgcctggaagtacagtttgtgaggtctacacattttcaaccaatattcatcaggcagctgctaggacccatactatgtctcagaggctgggaatgcagataaacaagaccagcacagccctgccctcacggggtttacacacaggccttgtcttaacattggcacatttactgagttgtcacttcttccgacttggatagcgggatgcaggacctaggaccccataggaaaacttcacatcactgtctcgcttggatgaaaacttcaagtcctgagaatgcagcgttgttcaaaacagaagcgatcactggtgctggccttcctagaacagtgctgagaaacagccgggaaaacgctgggcccctctgtgcacattcaagctgggcattgaaaggagcagacgccagtggcccctcgtgctggggagcccgtgcctgtagcagggtcctgtgcaccctgacagcgctgtcagatttcagaactcagccctgacgtgacgttctagatggcaggggtccttggggaaagctggaaaacatcctgcaggctggggctgcgtcctggcatgtggctgcagtgggctcccccagagcccaagggtttgtcagcgggctggttccgtgctgcccatctccgggttgggccaggggcagctagatgaggcgtcccccaaggctgccctccaggccctggagataagacgctgagggagcacatttctttccccagggaggtgactttccaggggaagagacagaatagacaacacccaggggagtgatggggacctcagagcaggaccaggccagccaggagtcctgggagctctatgcagcctggccctggtctcttggagaggtcaggagattggtgcgaggtggagacacagccagagcctctgccctgaggatggcttgttgtatactgagttgtatctagttgtggcacatggcttggagtgaccggccatctctgtcttccaggactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttcaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtgtaaactttttttctttttaacattctagttggaaacaacagatttctgattttgtagtttccatacaatatttaaaacatcacaaagaattctatcatgataaccactgaggcatcaatagtggtcgaggactaggggctctggagatatcgctggcttatctggtacatttgcgtgtgaataggcacattgatagaaactgaaaaactcagctaactccactgttcaaggaatcccttccttaaaagtgtccatccctagaacaaagcagcagccagtgtcaagtttaggtcttcacagttctctagcaatttgcttgttgctgatcttttgaagttggccttagagctgtgggagacagaatacaaaatgccaagtcctgaggaaggccattagaagtgtgagggaaaatgctgtcctgaaccaccatgaagcctgacatactcactacttctgtttatgtcttccccgaggaattctctgagcttctcatgccgggcgtggagctgatgggtcagtgggcaaacgggagttgttgtcaacatcagtctcatctgcgattgcattgtgtcagatgccaacggcctgtgtcacacacatacacgtgtgtatacgtgggcctttgcacgcctcgccaggtggtgtacatgcaggccttggcacgcctcgcccagtgcccgccccaggcccatgaggccccgcttcccagccgtgggtgtctgtgtctgctcacggcttcctccttcagcctggaccacgggctggaagtgaacgtaatctccagagccagctgtttgctgtagcctttacctctgaaagtagaaatctacgccaagaaaagttaatgctaaaagccacccctaatgtagactctacattaggactatttgtgtgtgtatgtttgctgttttattttcccctaaaaacacattttctgccaaccttcacgaaggatttcttcccaccacgaggccagcttatgtgggcagaaatctagttgaatgtgcctgagaacagggcttgaacaaatacttcatacacaaaagaaattttgaagggaaagcataatttctaacatataaagaaagcctctcccgcaggcaggtggagcagttagcggtgcctctctctgcctcgggtgcgttcacgcatagtgtctggcacaccttgttttattgctctttgctttattgcgtttttcacaaattgaagttttgtggcaacgctgagtcgtcgagaaagtctatcagggccattcttccaacagcccacactcacttcatgtctctctatcagtactgttaagcagtaaagaatctttaaaccaaggtatgtacattgttttttagacatagttctgtcacacacttaacagactccagtacagtgtaaagtgtaacttttatatgcactgggaaaccaagagacttgtgtggctcacttatttgggatcttcaatcttctttgctttaccggagtggtctggaacagtatctctgaggttcgcctgtgtttagtggtcctcacaactggggggtggttctaggaagtcctagggaatcctaacctctgtggccctgaaaaagcagaaaggtgggtcttcagggtgcatgcagcagtgtgcgtggccccacacgtcttccacatgaagatgctccaggtgcaagtcctaggcttgtgcgcctgcagggaaagcaccctctctgccagggctcctgctgtggccctgtcccttctccatggcagcagccttgaccgaaactgtgtagagtctcccacctcttcagggagctgggactcaggaaggatcatcttagctgaggtcataagaacctgcatgtagagaacttttcagcgtggggccactactgtgtcctgctgctgaggccaggtagtggccgtctgagggctgcaagggcaggctgctcccaggagttaaggaggcaaacactctgaacaccctggagaaatcacagtttatctttgcaactacaaatttgagtgctgtgtcaagtgaccaggtatttttgcagatgtctctgaggtgttaaatcacaggacctggccaagcaagatctctcagctggaccccgggcaggggatcctttatgggggcacatctcactgtgggggctgcagaaatgtgaaggtcatcatggagggagcttgcggtctgaaactaccccagccactgtgactaccacactgggagagatcatagacctgcatcctctcagatgacactgagcagttcaagctaaaaatgtgctggtaagcaaggtaagtgaattctaaagctaaaaaaaatcatttttcattttctgagaaggaaacaagtttgatatttcatacacagacaatatttaccatgcagactgtcaatttcttgaataaaaatatgaaattcatttaaaacattcaagtttttgtgtatttttctcaatgtattaacagaagagcaacctgtttcttggctgctcgattgtctcacctgcacatcaatccttttctatactctcccatggaagaaggggtctccaggggcaagagactttggtcagaggactgcagggagccaggcagcacccatgtcttggagcctcccctctccctagggcgtgtgccttgctccatattttgtgcctttcttctgggagttttcaagagcttgagaattttcctggagactctggccacagggcctgaagctcttagattgctcagaaccccatggtaaaggagcacactgagggtttgggggacttcagtgtctgggaagaaaagtaagatcatagcaaatgatttctaaaaataagaatgacaccaaggatggaagagctgtagtgtctcacaagacagtcactggaaaaagtagaggaagtgtggttggacactatttttaaagagatattcacacaattacctctaatctttaactttgtagaaataagcaaaggctacccatatgagaacccacaggagccactggttctgaacttgctatagcaagagagtcagccaggatcacttacttttggcagacactcaaaagcaggcagaggagtgggaaagccttatagtaaaaaataaaaggtggggagggtgaggagaagccttcagggatgctgtgattggggcttgttggcctggggaagctggaggcagctaaccaggaggagggcctcttatgtgattggtttgggggacacaggtggctttctctgtttagttcagtgggcaaaaaatagggaagcttgcagttcctgaccaagtcctaaccattctgggataattgttacagaggctgtggtttggcttcctggctagttctgcagagaatctgattcaaatcctctggccgtatgtggtctggccattgtctgtttgcatgttcagtctcttagtcccccttgtcggtcattttcttgtttgtaaaaggttggccaactcaaggaagtctagagatccagctcttcactgctcagagattattcagttgtctctctggtcaaccgtattgtgagatcttgatccttctgttgttatagcatcacagtgctcatttgacaagaatgggatgcagtggaacaacatcaggaccactatgacagaaacaagagcaactgtccctgtgagacgctttgaacgcaaacctcagctgaccaatgcaggccaagagcaaatcccatataggccatgaggatcaaccttagaaagccaaatagcttttgcctcaaggtgatgtgtgacctgttctaccttctcttgtttcactgatccagatgcagtattagcagtggcagaggccatcaccaaccaacaagaaatctacagcaatgagactgtccatcactactcatgccaatgagttgagactgataggtgccccatctagggaagaaggggcattgctaatgacttctgccagggttaatgataagtttatgacaacaggattcccacagatgagaacattgctctgattgtttgcataaacaatgagtcagtaactccccagttagagtgctgaataaccaagggtgatgttacggtttttgcagttttacaccaaccggtttgtggtaaatcgttacagcaaccctaggaaaaccaacgcaccatttctatgtatggttaatgcatggcaggtgtttaaaggtattgcaggatattggtgcttttcctttccccagtgcacctcattgatctcaagtgagggatttttctttttgtcttgatttttgttttctaagttgaacaatctttttttctcagtgtcctttctgtatacagtatctataagtgcccttgtcagtagctgactggttggggaggggctacccagctgtttgatcagcagggccacaagttaattttaggtcctgtcttatttttgttctaaagcacttttaaaatgtctgccaggtgttgtagttcaggttaaggggctatttcccattctcatttctgtttttgattaggtctccgatttcagatttagctccttgacaacaagcaatgaaagggccactttctagactcccaaatgatacaatgtattttctagcctatcccaaaaaaaactcctgcaggtccttttgtttgtttgtttgtttttgcatgacaagggattatggtctaatctttttggtggggggaatgtttgagatatggcttttagaagactttgccctatgttttgagcctctttgttaactcttcagttttattgtggacagtgggatcctaggatcccttttgggggagtctagtcaacttttgccattcaggatttagcatgcaaggttctggtcaatgtgtacaagttgatatgggttaggtaacactgggtcacatgcttccccccgccgctttgcgatagggtcttgctctgccaccaaggctagagtgcccgtggtgcaatcatggctcactgcagcctcaacctcctgggcgcaagtgatcctcccatctagcctcttgagtagctaggactacaggcacacaccaccatgcctgggtttttttttccatagagatggagatctcactatgttgctcatgctggtctaacttgtaggctcaggcagtcctcactgattcaccttccaaaatgatgggattacaggtgtgagccatagtgcctgaccaaagtattcttaattattttatgcatagttgctgatcttgcctgggtttggggaaatccttaattatggttattaatttagcttgggtctaaggtttaaattccacagttgtctgtatatggggctcatggaggaataggccttcagagaggcagctggcatcctggggtcataggagggttgttgtgaaagggcagggatctggacaagaggaagagaagtgtggacagatgtgtggaagggaagagatcagaaggataagggggagaagagggagagctgtattagggaagcaaatggatgataagcagaaggatttactaggaaaatgagtctaggttgttgctgcttaagtttgccaaatcgctcatcagctttagccagagtctttcagggaagcactttttgaatcagaatatcatttggagacctctgactaccaatcaaaaaaggctgctcattgggcctaagaaatcttattctctttcgtttctaaggcatctctcaaatgagcaattttgttcaagttagatgttctccaaataagatcttcaccaaatcaaccttggtgaagttaatgcttttcagagatgggcgtaaggattagaattgttagagagtatatgtaagaagcaggagttttttctggaggaggagatttaaacttagacaacaccatgaatgctggctggtgaggctggcgagaaatggaatgtttgtgtctctcaggacatgaaagcgagacggaaggagaacctcattcagttttactggaaacccacagcaaagtttctccaagtagaggccggtgtgatgagaactgctaaatcatgagctgcgaggctggctcaaacaagaggcttatgagccccatgcctgtgtcctttcctacggttttccttcttatgacaagcagcactttttgacagcacaacactaaacactaacacaaaatacagtgaaaagggataaaaagaatggcctgattccactagagatgccagacaaatgagaatcaataacaaaaccagagtaccaaactgagaataaatagccagagacctccacgcagagtgaggtgagccctagtgctgaccacatcggcgcacctgataggccgagaacatggaggcatgaggggcctctgggtggcacaatgggtggaagcctggggacctcagggacaagcagtacagacttaccatgggatcaccaggaaaactgtggaaaccagcaaaggctatttattcacaacttgctatagcaggggaatcagccagcatcacttacttttggtagaaatttaaaaggcccgaaagagatgggaaacttttattgttttgttttgtttaagtatcagattggaaattattggcaggaaatgtttttaattacatttttctgatattaaacccaacacagttgtactttaatattttccctaggagaactacttattttacaactatatcccagtgtatcacccatgatcagccacataatttgaatcatgcattatcttctctccacattcaaattacatacatttagtatttggctacttaaaaaaaaatcattaaaaagtaacaatttaaatccattgatgggagaacctcagttagtttcaaaacaacaattcttgccaggcggggtgactcacgcctgtaatgccagcactttgggaggccgaagctggaagatcgcttgagcccaggagttcaaggccagcctaggcaacagagggaggccccatctctaccaaaaaaaatattaacaattagccgggcatggtggcatgcacctgtggtcccagctactcgggaggctgaggcgagaggatcgctggagtcggaggtggggaggctgcagtgaaccgtgatcgctccactgcactccagcctgggcgacagagcgggaccctgtctcaaaaaatagatgaataaataaataaaaacaattataatggaagtttggataggaatttaaaacatgtggcaactaaccctgaccctgcggcttcagtctccccgccgctagctgagggccgtggccgctgcacagaggcttgtgaggattcgggggttcaggcagcgcccgccgcgcatctgccagacgtgcggccacagggtaggagcagtaagaaggatccagggaaaaaagtccacgaatgagaaaggaaacccagcgtttgtagggctaggagaacaaagaaagaaaatgctggcggcggagggcgaggctctgcggtgcgtggcagatgggaatttgctcggtggcggctcctctttctggagagcttcccagcgtcccctcccccgccagcccgcggtgacgcgcccggcacccaccacagccggctctcggcgccgtcgcgccttcgctcgcccgcttaggccgtgctcgcggtggcgtgggagacagagagcccagggaggaccctggaacatgcagtggtatggaagacgcctaagaaagggcttctctttccactcacgaaaatcagtgtgtgagctcgaagccatttcccagcgtgtccgcctcaactccctcattcaacagatgaggaattcctccagggaaatgcagtgatgcgctcacggctgccggcggcccagcgccaaggggcgctccacagccccgcggcccgaagccctcgactcggctgccacgcaggccccgcggccccgctcggactcccaggatcggcttccgagcgggacagcgctgcagtccacgagtccgggcaggggcgcctccaggccggagcggtttcctgcctcgggcactctgctgtctccacaaacggtttttggaggcacacacacggatactttaaacacgtcggtgatgaatcggtacccagctgccagtggcggagcttcctgggcggggccgcgggcgcgcggcggcttcatttcctcgcgcgcgccggaagtggcctctcaggcgcggcggcgcgcccgggggtgggtggctgaggcggcggcgggcccaaggcgtgaggcgccgcccgggtgtccccgcggcgcaggaggcggtggagcgcagagcgggcgagcgcggtgagtacctggcccggcctcgcccgccggtccgcgactcccgccggctccggcccgggcggtgcgggcgccggggctgcgggctcctgtgtggtcgggtggggtcgcctagcggaccggtcctgcggggggccctgtctctcagggatgagcctgccggagtcggcaccggttttagggaaagcgcggccagagacgattggttcgcttgtcagtgttgggttttgttttgtttcgttttgtttttacctattcatcaccatctctgctcctctcagtggataaactttttaatcagtggtgacctcgtcatcgcgttaaaatagttctgccctcagcccctctttatctgtagatggcagagcgagcgccggtaaagatgctctgtcgtggagggctcagtggggcggaggagatggggagcctctggcgttgtcggagaatgcaccttaaaaatgactctacccttgagcaacgcaggaagcacgacagtgatacttctgtttgtgatgatggtattggcggtatgatagtttgattatacatctgaagcttctcttcctgagtccttggcttgttaaacttggaggtattttctagcgtgcttttgagatagatatgggatgtcgtgacgtttcaccgtcattcaaggctcgcgggagcagggccttcatgtctggtaattaatgttgttttttgaatgttgtattaaaatagtagcttcgatcttggaagtaagaagccaagtattttaggactgagtgttagcgttcattttgtattattgttcttgtaccatttgtttaaagttgtcatgtaactaaaagaatgaaaaaagatggatttccagtatttgtggctcagaggattttggcctaaataaacacagttccaaccagtttagaagctgcatttttctctttgtttttgtcgaggcataaaatacatatgaaatcaataagagcacgaatcttaattgtacagctcaatgaatttttacatacttattaccctgtggaaccaccagatatatcaaattataaccatagaacatttccatcatcctattttcctgtgcttcttccaagtcagttatatccttgttttcccatctgtattctaacttctcttatctgcttttagttttctctgttttgagcttcatgttaatggaatcacgtagtattctcagcatattgtttgtgggacacacccatgctatttcatggtattgtattattactgtgtaatagtctattgaataatatgtgactactcttcagttgatggacatttatgttcccaatttttgtatatgatgtgttttggatattaagaatactgtgggcctggcgtggtggctcaggccttttatcccagcgcttggggaggccgaggcaggtggatcacttggtcaggagttcgagaccagcctggcaaacatggtgaaaccgcatctctactaaaaatacaaaaattagccaggcgtggtggcgggcgcctgtaagcccagctacttgggaggctgaggcgggaggtggaggttgcagtgagccgagatcgtgccactgcactccagcctggacgacagagcctgactcggtctcaaaaagaaaagaaaaaaaaaagagtactgtggacattcttgtaaattaaatgtcttggtgagcatctgtatgcatttctgtcagctatagaatgactgagtcatggcataagcagaaaattaccaacatggagtcattaccaaccataccattaccaaccaaaggcagaaaatttaaccaacatggagtcatcttttttttaatgtaatagaatttgttattttaactaatataacattcaaggttggttttaaaaaagcataactattatgagttcaagacgtaagtgattcattcattaccatgttattatttaccctttgaattgcacatttatgactgtcttctgtcggactgtcattgtttgtttaactgttagacaagtctgttagagctggtgaggatctgactctgaagtttagcataacatttacttaagaactgtattactcaagttagtggttttttagaggaaatgaaataccaaaaggatatgactgaaagtggattgaagaatcacgggactgcaagtcaaagaacttacattgttattgtcatgctacacaagcactaggtataagtgtaaaattgaattatagggctagttacaaatgtgaattcacagcaggagtacagtgattttcatatggactgagatactactagcacatttataatgtgaacacacaacaaaaatcactaaacatttgtgggaaatcggtagcatctaagagaagcttcagaccaaacaaatacagaactaggcactgaagcagtggagctaatgtaagacaaaagaaagctttaaagtaagtattagtatcttcaaatttgttaaggtattatgcctactgaacacatacaggctgccatgaaaaaaagcaattgattcttgaatatttaaacatggaaagtaggaaagggccaggtgtggtggctcatgcctgtaattccaacactttggaaggccgaggcaggaggatctctggattccaggagtttgagagcagcctaggcaacataatgagaccctgtctctacaaataattttttttttttttgagacggagtctggctctgttgcccaggctggagtgcagtggcgccatctcggcttactgcgagctccacctcccaggttcacgccattctcctgcctcagcctcccgagtagctgggactacaggcgcccgccaccatgcccggctaatttttgtatttttagtagagacgggtttcaccatgttagccaggatagtcttgatctcctgacctcatgatccacctgcctcagcctcccaaagtgttgggattacaggcgtgagccaccgcacctggccacaaatcatttttaaaattagcagtatggtagtgcacacctgtcgtcccagctgttcaggcagtggaggctgccactgcacttcagcctggctgacagtgaaactgtctcaaaaaaaaaaaaaaaaaaaaaaaaaaagaaagtgggaaagactacccatgacatgcaaagtagatctagaagagtcaatatacatctaataggagttccaggaggcattagaaataggaaaagaagaaataaccacagagataacagagatcgcgaaggtaggagtgtccaggcacagtcttgggcatcctgagccagggagaaataagtatcagaggacaaaggactggcaaatatagatcaacccttccctctctggtctgtttctttgtctgtacagtggggacgaacaagaagtatgccttttctgagagcttatggaaagatgtgttaggtttgctgactgttccccactcttcttccctaccagctcacagaagggattggggttgtgtgcccttatatgttgtttaacctttttatcacatgtatttattttgtgaaatttttaaagtgtaaaaattttttagaagttaaagcaggggttgccagtatggctggctgcctgttttagtatagcctgtgatctaagactggcttttacactttttattttttttattttgtatttatttatttgtttatttatttatttatttatttttgagacagagtctcactctgttgcccaggctggagtgcagtggcgtgatcttggctcactgcaacctctgtttcctgggttcaagtgattctcctgcctcggcttcctgagtagctgggattacaggtgcatgccaccatgcccggctaatttttagtagagacggggtttcaccgtgttcctcaggctggtcttgaactcctgacctcgtgatctgcctgcctcagcctcccaaagtgctgggattacacgcatgagccaccgtgcccagccctatactttctaatgctttggggagaaaaagaaaataatgcttcatgacccatgaaaattatatgaagttcaaatttcagtgtcccttggaacacaactatactcattcacttacatatcatctgtgactgcttttgtgctgcaaaggcagaatcaactggttgtgacatttactgtctgacctaaaatatttgctgattcctggtttagaggtcagaaatggacttatgcatatataggaattttgctaatgataaagatggcatttcaaactagtgacaagagcatggattgcatggtaaatggcaagaattagctatctatttgagggaaaaattacttttattaggattacttcaggtagggaagctaaaatcaagaaataggaaaagattgatagatttgagtctattaccaccaccaccaccaccaacaaaactttgcttaataggaaataatatctaacagttactgagcacttatgcttgtcatgttttacttgaataagtgttataattatactctaaggtaggttctgtaattattcccacttaacagaggaggaaactgaagtttacatatattatggaatttgtctgtaatgaagagtagaaaaccatgatgcagatctttgaattcaggccatctggctcccaagcctattgtggacaagacaaactgagaaaaaatatttgcaacatggtaacaccattttgtaggtactatctacatcagcacataaagatgtacctaattcctttaaaatattctgttgtataaatgtcttcagttaatttaacctttcctctattgatgaacattaagttgcttataattttattttgctgttacgtgtaacactgataaacatcctatgtatgtgactttatatagtagtatggatacttctgtagtatagaatcaggaaagtggaattgtgaattgctggattaaacggcctgtgcatttaaatcaagtttgctctccaaaaatgtgtgtgtgtgtgtgtgtgtgtgtgtgtgtgtgtgtgtgtgtggaatcataataaaggaatcataatatcttggaaggaacattgactgttcaggcaaaactgcctcatttttgagaggaggccctgagaggtgaagtgttatgcccaagattacatagctattaagtagctgttacacttgactctttaactggtttttgctgtgccacagtttggcacatttttctcctttgtcttgctgaaatccaggtaccatgattatagttttctccagaaacacgctgttaaaaggatccatttgatattacttgtccttggtactcagcacagtgcctgacacacagtaggtaatcaagtatttgttgaaaaagtgctgctttcagatgatcagtacttacagaccacttattcaataacatgttgacaacccatgcatcactgtaatacttatcaagtaatcaagaacttatcaagaaatgaaacattctgatctcctccttcctagatatttacacttcataatgctttagttttctgactggttatgttttccaaataattgtgtggctttgtttttgctttgtaaaaaatgaactcaaaattataaatttagtttttgaaaaccttaatgagaaattgttctgtgcagaaaatttaggaagattatacagaatatgttttataatacactcaaatggattatatctttcagagggcagtagattagtcttccaagttagcttgacatactgcatgcaatgtacatgtcctggaaatgatgcataacatttgtgttcatagtaccaaaaattgtgtataatcaagattgagtaaaaactccttaagggtcttattattatgtaagggaccagtgctgtagcattaactatctttaacacttctgttgtctccaagtcacaaggcaaggagaaaagatatggtaagacctttaaaggaatatgtaaatatgtagtactctatttttggggagatgaggggcttagttttgttttttaaatgcaaattcataatcaacaaatctttatacttcagtaaacaaactggaggggtttttttttgttgttgttttacaaatgcctttttggcactgctactgaatctgacttggctttattttttaaacagcttcattgaggtataattgacataaaataaaccacatatttaaagtgtgcaatttgataagttttaacatatgtatacacctgtgaaatcatcactgcaaccaaagtaatgagcaaatccattactcccaaaagttttttcacccctttttataattccttcctggtaccacctcccacaggcaatcattgactgatttactttcagttaactacaaattaccttgcattttctaaaattttatataaatagaatcatatagtaagtacttctgttgcctggctcctattactcagagtaattgttgatatttatccatggtgaagcatgtgtcagagtttattcctttttattgctaagcagtgttccattgtgtatctgttttactacagtttgtccattcacctgttggtggaccctgggttgtttctggttttgggctctacacctagaagctgctatgaacatttgtgtacaagttttggtattgttaaagtataaactgaggcagaataaaattttaaagagttttgtctgagcaaacagcaattcatgaatcagacagcaacaaatcaaaagtgatttgggactccaccaaaggaatgcaagtggaagacttctataggatgaacaaggaaacaaggcaaagaaaatatttgattaattatatttatatagttgccttgtttagtccatcctattggaaagtccctagttatgtaagttagttgatggcttctaattggcgtagcctaagtttgtttgtttcttttttttttttttttttttttttaagagacagggctagagtgctttggtgcgatcgtagctcactgcagctttgaactcctgggctcaagtgatcctcccacctcagcctctcaagtaaccagggcaacatgaactacagacatgcatcgccacgcctggctaattttttaatttcttatagaggcaaggtctcgctagctatattgcccaggctgatctcaaattctggcctcaagtgatcctcctgcttcaacctcccaaggtgcttacaggcatgagccaccatgcccagcctgatttttctttaatataggcacagacaaaaaataaccaaagtttacatttgcaaacagcccaaattaagttttgcttctattgcttatatttgcaaggtcaaggttgttttaatggcttaactggctttgtccaggggatttacagacctggtctccatcttattttaatagtatgaatatgtgctttcatttcttttaggtaaatatctaggaatggaatggctggatcatatgagtaggcttactcacttattaagaaacttggcctggactacatagcaagactctctctctaaaaaaagatttttttttaattagccaagtgtattagtctgggttctctagagggacagaactaagaggatatatgtatatatgaaagggagtttattaaggagaattgactcacaccatcacaaggtgaagtcccatgataggtcatcagcaagttgaggagcaaggaagccagtggtggatcagtacgagtcccaaaagtagggaagctaacagtgcagccttcagtctgtgcagccaaaggcccaagagcccctggaaaaccactggtgtaagtccaagagtccaaaagctaaagaacttggagtctgatgttctaggtcaggaagcatccagcatgggagaaagatgaagtccataagactcagcaagtcagcccttccatcttctcctgcctgctttattctacccccgctggcagctgagtagatggtgcccaaccagattgagtgtgggtctacccctcccagtccactgactcaaatgttaatttcctttggcaacaccctcacagacacacccatgaacaatactttgtatccttcagttcagtcaagttgacactcaatattagccatcccaccaggtgtagtggctcccacttgtagccccagatactcgggaagctgaggcaggaggatcacttgagcccaggagttaggctacattgagctataatatgatagaggcactgcgctacagctctggtaacagagcaagatgctgtcttttttttttttttaataagaaaataatctaacttgttaagttcataacttattaacaaaactattttatattcccatcagcagtgtatgaaagttctagtccttccacgttaacaacacttggtatggtcattctttttaatgttagccattctatttttagcccttctgtgtagtggtgtcttattatggtttgatttgcatttccctaatgactaacaatgttgagcatcttttttttttttttttttttttttttgtggagacgggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagcatctttttcaagtgtttatttgaagggttcaggccttttcccacattttaattgagttgtgtttgttattatttcattttgatcattttaaaatatattcttggtacaagtcctttataagacgcatgctttgcccatattttctccaggtccatcacttgtcttctcattctcttaacaatgtctttgaaagagcacagattgctaattttgatgaaattcaatttatcatttatgctattgaatatcatatctaagaaatctttgcctaactcagagtgacaaagattttatcctatgcttgcttttggtttttttccatttaggtctatgattcaccttgaattacatgctagtggatgtggagtggtatctaattgtgcttttgatttgcatttcctttttggctaatggtgttgagcatcttttcatgtatttatataggccatttatatatcttctttagagaaatgtctgttcagatcttttgcttgtcgagttatctttttttttttttttttttgctttttaaagtaagacagacaaatgatttacaaatgttctctaattgtatgggttatttcttcactttcttgttgatgtcctttgcaacacaagtttttttattttgatgaggtccagttaatatttgttttgtctttggtgtcatatctaagaagctgttgcctgatccaaggtcacaaatatttacacataggttttgttctaagagttttctagttttgactcttatattcagatatttgacccattttgagataatttttgaatgtggtgtgaagtaggagtctagtttcattcttttgcctgtaaatatccagttgtcccagtactatttattgaaaaaactattctttctcccattgaactgccttgctattcttgttgaaaatcaactaaccataaatgtgatgatttatttttgggctttaagttccattccattgactatatgtctatttctatgccataccacattgtcttaattacctggggctctgtagtaatttttggaattgggaagtgttttccttcaatttcatttttcttgttcaatattatttgggttattctgggtttcttgaatttgtataaattttaagatcagcttgccaatttctgcaagaagtccactgggattcttgaagaggattgtgtttaatctgtacattaattggggaatattaccattttagcaatattaagccttccaatcatgagtgtggtgtctttctgtttatttaaatcttaactttcttccaacaatgttttgtagtttctatgaatacaagtcttgcagttcttttgttaacattattcctattttattctttttgatgccatattgtatacaggattgtttttttaatttcattttcagattgcttgttgctaatgtagagaaatacaattgatttttgtatatcgatattgtatcctacaactggctgaactcatttattagttataatagatttttagtgaattccttaggattttctgcatacagatcatatcatctgcaaataaggatagttttacttcttccttttcaatctggatgccttttatttcattttcttgcctaattgccttggctacaacctcctctagtacaatataaatagaagtgacaagaacagacatccttgtcttattcctgatcttgggggaaggcatacagtctttcatcattaaatacaatgttagctatgggttttttgtaggtcccttttcttagattaggaaggtgtcttctagtttattgaatggtgtttggtttggtttggtttggttttttgagatggagtctcgctttgtcgcccaggctgcagtgcagtggcgtgatctcggctcactgcaacctccgcctcccaggtccatgtgattctcctaactcagcctcctgagtagctgggactgcaggtgcatgccaccaccacacccggctaattttttgtatttttagtagaggcggggtttcattgtgctagccaggatggtctctatctcctgacctcgtgggatctgcccacctcggccttccaaagtgctggaattacaggtgtgagccaccgcacccagcccctattgaatggtttttattaggaaatggtgttggattttgtcaaatgctttttccatgtctgttgagatgatcaagtgaattttgtcttctattgatatggtatattgcattaattgattttcagatgttaaaccaaccttgcagtcctgggataaatcttatttggccatgatgtatgattcctcttatatattgctgggttcgttttgctagtattttgttgaggatttttgtatttatattcatataggatattggcctatggttttcttttaatgtctggatttggtagcaggatgatactgaccttatagaatgcttcctcttctattttttggaagagtctgtgaagataattcttatttaataataataattcttatttaaatgtttgctaggctgggtgtggtggctcacgcctgtgatcccagcacttttcgaggctgaggcgggtggatcacctgaggtcgagagttcaagaccagcctgaccaacatggagaaaccccatctctactaaaaatacagaattagccaggcgtggtggtgcatgcctgtaatcctagctactcggcaggctgaggcaggagaatcccttgaacgtgggaggcggaggttgcggtgagctgagatcgcgccattgcactccagcctgggcaacaagagcgaaactctgtctcaaaaaaaataatagtaataataaataaatgtttggtacattccaccagtgaagcctcttggcctggacttttcattgtgagtagtttttttattattattaattcaatcttttgtcatataagtctattcatatctggtatttcttcttaaatcagttttgttagtttctatctttctaggattttgtccattttattcagttatcttttgaagagatttagataataatgagcaaaaatcttagttaccaatgtcgttaacattaatgatgtttttcattgctttgtataaatccatattcctttctggtattatgttcctctgcctaaaagacttacagtacaggtatgatggtgatgaattcctttagctttttatgtagagaaagtattttgcctttttcaaagataatttctctgggtatagaattgtaggctggcatatttttctttttagttctttaaagatcattgttccactgtctaattactttcagttttcaaagagtaatctgtcattattatcttttgttccttgtatgtgatgtgcatttttcatgtggccagtttaaagattttctctttacattggatttgagcaatttgattatcatgtaccttgctataattttctttatggctatttgggattggttgagcttcttatgtgtgtttatagtttccatcaaatttgggaaattttcagccttatttgtttaagtatttctcctgactccttcccccttctttggggactccagttacatgtatattaggctgtttgaagttgtcacagagcttatcaatgctttgtttatatttttgattcttttttctttctgtatgttgcatagtttcttttgctacatctctagtttactaatattttcttctaaaatatctaatctgccattaatcccattcagtgtatttttcatctcagacactgaaattttcatctcctgaagtttaacttggatctcttttatgtcattcatacctctacttaaatttttgaacataaacatcattttaaaaatacagttatgatagctgttttggtgtcctttttctgcagattcccacatctgtcagttctaatcattggtcagttttaattgttgatttttttcattatggatcatatttttttatacctggtaatttttgttgagatgccagatattgtgaattttattttgttgagtactggatatttctgtattcttataaatattcttaaggcttgttgtgctattacttggaaataatgtgatcctttcaagtcttgcttttaagatgtattggcaggattagtgccatgtttagtctagagctaattatttcccactactgagacaagatttttttgagtgctctaccgagtgccctgggaattctgaggttttccagtctgtctgttgggaacatgcactaatcctggccctgtatgaatgctgggttctgtgtcctctaattttgtgtgtggtcctttccttagcccgttagttgcctcataagcctttacttatcagtgctctgccaaatacccatgggatatcctattcagatttctggagttctctctgtgtgcagctgtatccactctggtactatatgctttaatcctagataccttggtctcttcagactatgagctgcatcccatgaactcagggaatctgctgggctctgcttaggttcccctccttgtgtggctcagaaactaaggcagtaagctggcaaccacttgtttcttgtttctctggggatcactgtcctttgttacctgatgttaaatatcttgaaaatcattgtttcatattttgggtttgttggcaggaaaagttgtttgtttgtttttggttgtttcaagacaaccaaagagagcaaatctgagagtaaatctggcccgttacttcatcttggtcgtaaaaggaagtcagttttttaagcagttttagagagttagaattgatggcttgtaaggtttctttcaatcctgagatctttggcttcatattacatacctttaacagcttattttcccatcttcacattatccttttctctcctcaaaacacttaactatctgcatttgtgcttagaaggcttgttgggattaactctgggctgtgaatgaaccgtattcatgatacaaacacatttcatagaatgatgacaatcaagatgtaacaacagaaaaatgttttctataatattcttaatatatttatatgatagaacagctataatgtaatcttctagattatggccaaagagtttctttcgggaactaggcaaataagattttaattgaaatctttcatttttaataaccacagaattatgcaacttttacattctgaagtaattacagtatcctttcattttattggaaaatattcaactgtaatattaagtaggatatctcaaaacctgtatttcccttaaagggaagaggaagaaaaatgaccttagctttttaacactgccactgataatttccattctattttattgaaaagtaaaccttcagtagtgacctattgtctgagttatagctcatagtctaaaatacattgtgtatataaagaaaacatatgaggtaccatattaataaaagatagtggtagttctgttacccagtttcacttcagttttgagtataacatgcttaagtatgtatatctttattaattaaagtatgtatatctttattatacaagattatgtctccacattttcagttctttttcctaataaatgggctagtaatagttaaaacagataccgctaggtttatcttttaaataatgaaattcaagtgttttcttatgctagggattatggttttgaggtatggttaagtcctggaaataatactagttattttttgattagatggtatttcttaaagccaactattttttttctgtttttttctacatcactcaaacaagatttataatcagtaagagagatgctgtaatagtaaaagactcccttggccaggcgcggtggctaatcccagcactttgggaggccgaggcgggcggatcacgaggtcaggagatgagaccacgatgaaaccccgtctctactaaaaatacaaaaattagccgggcgtggtggccggcgcttgtagtcccagctactcgggaggctgaggcaggagaatagcgcgaacccaggaggcggagcttgcagcgagccaagatcgcgccactgcactgcagcctgggcgacagagcaagactctgtctcaaaaaaaaaaggactcccttgtagtgagttaaatttttcaagatacttggttatcatttcgtttactaaaataataaatgactaaggagagttaagaccattatttgtggtatattggccataagaagttttcttctgtcctatgttttatacagacatgttaccaaaaaaaaaaaaatacgcattgcagcatttgccacagaaagcatccaggtttttctactcattaaaaaagtggctaggactgataacctgtagtgatcttccaggttttgctgcagtgagaaaaccattactgttaaaaacctgctgtcatatcacattatccttctcaacaagcactttgttacaatggaagttctctttgcagtggagtcctccttgcctcccttgtcctaagttaaacctctatttttagagttaagaatcattaaagacatggaagagttcgcacaactggttgtggcatgaacgatagcatgtaattttataaatgtataaatggtttttgaatttttttctctgctgataaggatgattaaattcttcatgttttttctttatatagactccaaacctttctagacttgtaggaaatctgttgatgcataatacagtggaaagaattatgtgatctaatgtgcaaataatctactggaggacattggatataaaaatgttttcttaatgtgtttttcagatgtctgtgagcttttgaagttgttctttcccccacttaattttaagtctcctagattggctgagctgagcagtagaaattaatgaggtagaatgcttgagttgaataaactgggagaaaatctctctctccagtaaaccgttattactgtaacagaaacagtttctataaactcagttcccaaatggtcataagctttagttgggaaatggtgcggtaattgaaatactatgttaataaagagttataggcaatataattttcaaataattagagaacagtagaatatatgtaatacagactatgctgacgtaattttaatgtttctttgattcaagttatagctgtgtagacataatagttaaaagtattatacatagtttattgttttttaaggtattttaaaaaattctcccaggccaggctcagtggctcacacctgtaatcccagcactttgggaggccaagacaggcagatcacctgaggtcaggaccagcctggctaacatggtgaaaccttgtctctactaaaaatacaaaaattagctgggagtggtaggcagatgcctgtagtcccagctactcaggaagctgagatggaaggatcacttgaacccaggaggcagaggttgcagtaagccaagattgtgccactgcattccagcctgggtgacggagtgagactccatctcaaaaaaaaaaaaaaattctcctagtatttactgaatattctaaattatattagtacctctcatagttctctgcatgtagtagtcacgtagctaagtttactgaagccacaaacaaatttgatatccttaagggaacaaaattctgattgattctgatctgtgtctttcagaaaaatcactaccaatataatggattttatatatcagattgctttattctggatatcatggtaacaatacagaaagtatacataatttcccatttctgcaagtagtcatgactgctgaagaaagaaaaacttaaagctacggcagaattattttatggaaattctgattttgtttttaatttttgataactttttactaaaggtatgaacacacaaagagcttattttgttaggcaaatacacattaataagaatgcctagaagaggactgattcttcacacccggacccactggttgctgttgggccttgctttgctctgcagtttggtattatttatgtacctcctggaatgtgccccccagactgatggaaatgcatctcttcctggtgttgttggggaaaattatggtaaagagtattatcaagccctcctacaggaacaagaagaacattatcagaccagggcaaccagtctgaaacgccaaattgcccaactaaaacaagaattacaagaaatgagtgagaagatgcggtcactgcaagaaagaaggaatgtaggggctaatggcataggctatcagagcaacaaagagcaagcacctagtgatcttttagagtttcttcattcccaaattgacaaagctgaagttagcataggggccaaactacccagtgagtatggggtcattccctttgaaagttttaccttaatgaaagtatttcaattggaaatgggtctcactcgccatcctgaagaaaagccagttagaaaagacaaacgagatgaattggtggaagttattgaagcgggcttggaggtcattaataatcctgatgaagatgatgaacaagaagatgaggagggtccccttggagagaaactgatatttaatgaaaatgacttcgtagaaggtaatgtgaaaaatatgttggtcaatattatgttagtaagacaaatgctagtattgtatgctggtattgtattgtagtattgtactgtagacaaatgctagtattgtattgtagacaaatgttagtaatataagtcagtcattatccacagtattaaaacactgaaagtttttgcacttcattgcaccaagaattttaagtggccttctggaaaaaggtatgagatcataataaaaatggagaataaggactagggaaatagaataaaacagctcttgttgcatgtgtatgatttatattcctcacttacctgatcttggtgttcttttttatgtttttaaaaaatgtgtaaactaaaactcaaaacttgaaaaccatttgataaaggaaagaaaaaattagtagactcttagctatttttcgtattggaggaaggagaagctcatgtctgaacaaggggttatacatagtttaaaaagcacatttggcatttggaaaagtaaggaaatacctgttttcctaatacatatttcagaaagggtatggaatttttatgtatcaagatgggatgtgactcagaggttgaagaacactgctataaaatttaagatattgattgatattaacagtaataattctagatccctacccatctcctttacactcactgctagacatttaattgctgacttaaaccattttaaaaataaatgtttcttgaaagttctctttgcttgattctataaactgtgttatcacagtggtccccagcctttttggcaccagggactggtttcatgggtgacaatttttccatgggatggtgaggatggttttgggatgaaactgttccacctcagatcatctggcattagttagattctcataaagagcgtgcagtgtagattccttgcatgtgcagttcacaacagagtttgctctactttgagaatccagtgcagccactgatccgacaggaggcggagctcagacggtaatgcttgccaggctcccatcactcacctcttgctgtgccgcctagttcccaacaaacaggccacggaccagtagcggtctgtggcctgggggttagggacccctcgtatagcacatgtagactttttgactccaaatcatcatggccatcacttgctgcactgtagcattattataatacactgaggcccttggaggccatcagggagggcattatgctttgcagtggcattgcagctgcctttccttgtggcctcctcttttttctgctgtcacttcctgccatttttgatggattatttttctcaaaactcttctgatttttctgcaagctcagctttttgtcttctcactgtatgtttgtagcttatggcagaattggaagctgcggaggaaataagataactaagtaacatgtgtaaaatgtcctcacatcagctctacctaaaaagaaagggagctgtgccagttttatattctgcagctcctgcttttgtcttataactctccttggattctgatacttcaggatttttctctaaatggaacatattctgttcctcacttttcctctactgtgccactgtctgcccactgcagggagaataattactaataattagtaatgacaactaattcctatccctcttctaaactttagctcagatatcacttcttctgagaagtcatctgcaacctcaggtctaagacagcagtacttctgtgtgctcttgtcacctgtacattcatactgcttgtcacagtatgtggcattgcccatttcctggtttgtgcttcctactaaagtgtaagcctcaggagggttgggaccaagtctattttattcaccattttatacccagatatttactgagtgactcacacatctgtaggtctaaccttcttctctctcctgagcgccatacttaaaaatcagattgccactgggcgcagtggctcactcctgtaatcccagcactttgggaggccgaggtgggcagattatgaggtcaagagatcaagaccatcctggccaacatagtgaaaccccgtctctactaaaaatacaaaaattagctgggcgtggtgacacacgcctgtagtcccagctacttgggaggctgaggcagaagaattgcttgaacccgggagatggaggttgcagtgagccaagattgcaccactgcactccagcctggtgacagagtgagactccgtctaaaaaaaaaaaaaaaaaaaaaaatcagattgcctcgtagatgcgcatgcttttctctcaaaggcatctcaaatcactgtgtttaaatctgtaccaatttttctttgacttcactctagtcagtgattttatatgtatgtatgtatacacacatatatatatacagatatatatatatatcacatagcactatattgttattatttgtctatttttctgtctccttcactagactggccctgtcctcaaaattgagaccatgtggcactctttgtatcacataactgacacgaaggcactcgatttcttttagttgacctaaaccaatagaaattttggctcttgggtctagattttaatattgctagaagtaatttctttatttatcatgattaccatattgataggctctagtatttttaaaaagtcgtatgtaaaaaggaacaattgtcatttgtagtatattttatagattgaataaaataacagaacagtgaactttttttttaaccttttcttttaagcgagtaattgttactgtgcagtggggataagtattttcacaaataggtaaaaatcctgcaggtctagtttaataccctttatgtttaagtgagtaaaatctgtcttcccattgaatttgtaaactttgacatggagacgtctttgttcctaactctttcctttaggttattatcgcactgagagagataagggcacacagtatgaactcttttttaagaaagcagaccttacggaatatagacatgtgaccctcttccgcccttttggacctctcatgaaagtgaagagtgagatgattgacatcactagatcaattattaatatcattgtgccacttgctgaaagaactgaagcatttgtacaatttatgcagaacttcaggtaactgtcagggcttaatgattaagctacattctcctaaaaaaaatcacgttttactcagatttccttaatttatcttcaccgattataattacttagaataattttacaggctttaggggaactttatttttttatattctctctttttttaaagcatgtgtagtatattgtgttatagacaatttgaactatgaaataaattaagagtgacacctattagaaactaaatttgatggccttgataattgttttgaattcattttaagacaagttgaatttttaaaaaatcaactttactaaggaataatttacatgcagtaaaatccacatattttaaggatataggtatcatgactctttttttatttttatttttttttttgagacagggtctcactctatcacccaggctagaatgcagtggagtgagcacagttcactgcagcctcaacctcctgggctcaagtgatcctcctgcctcaacctcccaagtagctgggaccacaggtgcatgccatcttttttattctttgtagagagaaggtcttgccatgttgtccaggctggaatttaatgtcttttgacaaacgtatacactcacgaaccaccaccccaattaagatacagaatacttgtgtctcacaagaaaatccccttgagaatgatttgagttttttaattgaaatacatttagacatacaaacattaaactaaaaattggagaaagttatttcagcttgcaaagcagagaatttgtaaagtttttttatgttatcaaatttgtatattttaaaatgctgaagtgttaaataattatctacacattatgaaaactatttgtggaaaatgctttttgatttaacagtttccatgtttctaatactttaatatttttaatgttttagatactttgatatactggtttaatgctttgtgatcctagtctttattctcatattgaaattgttggatttaaaaggttaattaaaactggtctgcagctgaatgtctggcagtcatacttccaagtgagatttactgttccaaatagctcacttgagatccgatttcctaaagcatttttttattgcctttcttggaattactttcaaaggccacattattatttacagtaagtaatctcagtcatggcaaatatttattccttaatgatagttacaatttttggaattagccagtctgaagacaaaataactcttaatccaaaaggtcagtatttatttatgtggttctgaaccagttgagtttatttccttgaatagcttgtgatttgcttctgaaagcaatccaaaagcaaaagttcaaaaaatgttttgaaataatggcagcaatgtcagactgcttccatggccctccaaggggtgcactcattcaggcatagaccttgtgccttccataattcatcagtattgccacatttatgtttactactgtgtcagtaatgcctcattttcttgttaaagcttcatgtggttgctttcttaatgaatagtgcctcatgttttcttgaataaacttttatttttcacttctgttagggatgtttgtattcatcaagacaagaagattcatctcacagtggtgtattttggtaaagaaggactgtctaaagtcaagtctatcctagaatctgtcaccaggttggtgaaccacatctgcagtgaaggccttgatatataacattgctaaaagagaatttcagatatgtaatgagttaataatttttagtaactattatttaaaaattggctgagcatgtgggcggtggtggtgatgataagttcctcatttcacatgcaaccctacatgactcaacttcccttcactgcttagcaagcagcctggcatgatgctttctctgtggcccactcaccttctgtgtatttgctgctgctttcctttttttaaaatctaattccttcactttgacataatcatcttctgaatttgtctcttttttgtcacctttctttccttccatttcctcaggctccttcttctccccctgctaacaatgttgaggtctcccatatccttaagaaactcccactcaactctgaagtgcccagccactactgttatgtttctgtcctttcacagctcaacatcacgagacagtagttcatagctaagcaagtcatatagtacctggcacatagtagatgctcagaggtttgaatggatgaattagtaatcccttagtacttaattattaattctttagcctctcagcctttttctttctaaatcatgggcccaaagataacgacttaactgccaaattcttttctgttattctttttcattgcttttttacctttgacaacctaaccagtatttctgtcttaaaatgttcttcttgtgtttgtaaaatgtaactattttgtaaatgtaagtatgatgtaatgtaaactattaggttgattatcatctctaaccacaccagctctatatcctttacttgcttctttacctttctgccagttgtggccatttgccaagagcccagatttgatcagccattcttctcaaatcattcaactcacattcattgagtcctgcctactgtgttccaggtacactgcttgggagtttgactggggtagttggaagaagagtgggcgtagatgagtgaatctgagtccctgacctgcagggattctcagagccttgatgtatatagacacaattcactgtcttccccttccctacaccagctcctcctcctgatggccctctttcagttcagagtaaaaccattttcaccatctgggcatgacttctgagagccacagtcttttacttattctttgcctccagttacctctaattagttagttcctacttaattcacaggacctcttctctatctcttccttgctactgccaccaccctaaccctggttccccctccctccatttcttcccttcctgtccctccttagtgtttttagatcacctactaagtgccacaagctcacactggtaatactgaagtattgtcaagacacttctgtggcaaatggtgtaaacctaccttgagcttgcttgaggaaaataggagcagtattgaagaatctcggatacctcccagaaataaagggattgttacaaccaaatttggggaagaaaatcaaaacaactcttgtttctcagggattggaaccagagacttgaataccatcaaaattctcgtctccttgtctgtttttctctgcatgttgacttcattctcctgttgcagattggcttcttccacatggtgagggatatgactgttggcggctctgggctcacatcttctcagctttgccatcagagaggaaagagctttctcccagctccagttgagaaaatcccagggaaggacattttgcccactcttgagccaatcactatggccaggttgggtgggggtattgggactggcccagcttaagcctggtctccacccctaggaaattactgtggttggggtgggcagagagtgaggggtattctgtgatcagtgcctccacttgatgctgagtatgtggggtggcaatgggcagttttcccccaacagaggagagatttatattccttaagacggggagaagagtcctaggcattcagagcacttggagtccactccatgcactatttgagcctttgttccatctctccattacccattctgtactgttgtaagtgtaatcctcctaaaatgttacttttttgattaggctgcaccctagtgcagtgagtgattctccagcttcagtgccagagtcaccaggaggacttgtgaaaatgtagaggcttctctccagccctagcatctgattcagtgggtctggctgtagtctgagagtttgcttctctaacatgttaacacaggaagctgatgctgtgggtttgggggcctcactgtgagaaccactgccctagcagaaaagtcctgctgattctctttgcctttaggatactgaccaatttctttaaccttgcatgggaggtactcttcactctgacccttctctcattgttcccattttaagattccgttgacccttatctcactgttcccattttagggtccttttctaccaatctgatttgtctgatcccttttctctaaaatgctttctacattcttacctctttgcctttgagaataattattttgaatgacctttacactcaccactgaattcaacattttaaccaaggcataactcacgttccacttctaacatcttctctaactactccagacatgagcgatgtatttttcagaactgctgttcattcattcattcagcaaatatttattgaactcctactctatcaggggacactgcatccatagtaatgaacaaaacaaaatccctgctcccacagagtgggagagacactggaacaaatatgtctagcaatatgaaggaaaacagctgaggaagaggatggagatgaaggagtgggaggtggcagctgcttctcaagtagtattagggaggatccctctgataaggcgacatgtgtgcaaagacctaacggatgcaagaggagagtgatctttgtgtgtgttatccatttagaatgcattattaacagacattacagctatttttccatttgtgtatttttcaactccccaaaaggtgtttaagattccaaaggtcagtggccactttaacacttttggagcctcataccaccaacatgtgcctcaaattgggcatttggtgaatatctctccctgatgataatcatacacatgaagctgggattttctttccctttgtgaatgtagaaccaatataatcaaatatttgaagtgtaaaacatattttgtaagctgtgttgaaggaagaaaattggtaactttaagtgggacttatcatttgttgtgtgtgctttcctcatagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtgcgtaaaatgttggtagatgagctgactatagaatttagaacgttgtcagcatgtcctatagtttgaatcaagtgattttgagggagaagttttagttaaaccccagtatttttttaagttatattaggcataatttaactggaatactaaataggaaattgaaaatttgaccctttgaaattcatatcctttgttctcttgggtccaacttccagtgactacatttgaagccaaatatggaaatgcagaggaacagggtatctacaaattgatgaggtgggagcagtgcaggtcagaaaaagagctaagcagatggtatggagatgtgtgtgagagtctgaagcactcagctttgggcatatagcgtccacacatgcaaaaatacccccatgcatgtgtgcacacacactcacatggaagtctagatgcagatagtgcttggtctccagactgtgcattttgggatgatttactatactttgctttaagttgtagatattttttgaaaattaatgagatagccaggtgcaggggctcacgcctataatctcagtacttcgggaggcttaggcgggtggatcatgaggtcaagagattgagaccatcctggccaacatggtgaaatcccgtctctactaaaaatacaaaaattagctgggcatggtggcgtacgcctgtagtcctagctactcgggtggctgaggcagaagaattgcttgaacctgggaggcaaaggttgcagtaagccaagatcatgccactgcactccagcctggtgacagagtgagactccatctcaaaaaaaaaaaaaaaaattaatgagaagatgacattttttgaaatcaaattttaaatgctttttagttcatttaaaagaattaaaagtattaaagaggctgggggtggtggctcatgcctgtaatcccagcactttgggaggccgaggcgggcggatcacgaggtcaagagatggagaccatcctggctaacacagtgaaaccccgtctctactaaaaatacaaaaaaaattatccggtcgtggtggtgggtgcctgtagtcctagctcctcaggagactgaggcaggagaatggcgtgagcccaggaggcggagcttgcagtgagctgagattgcgccactgcactgcagcctgggcgacagggcgacattctgtctcaaaaaaaaaaagtattaaagaatctcaacaggatgagtaagttgaggaaatctgttatacaaacatggtgactatagttaataacaatgtattgtatacttacaaattgctaagccagtagtagcattaaaaaatgttcttaccaccaaaaaaaaaaaaggttaattatgtgaggtgatgatatatgtttattagcttgatttagtcatttcgtagtgtatgaatgtagcaaaacataatgttgtacaccatttttattagtcaattagaaaaacattggggtgggggggtgctgctgagcacagtagctcacaccttaatcccagcaccttgggagtctgagacaggaggagcacttgagtgcaggagttcaagaccagcctgggcaacatagtgagtcctagtctttaaaaataaaatttttggccaggcatggtggctgaatgctttttagctcatttaaaagaattaaaagtattaaagaggctgggcgtggtggttcatgcctgtaatcccagcactttgggaggccgaggcaggcggatcacctcagtcgggagttcgataccagcctggccaacatggtgaaaccccatctctactaaaaattagccaggcgtggtggcttgttcctgtaatcccagctacttgcgaggctgaggcagaagaattgcttgaacctgggagacggaggttgcaatgagctgagatcgccagcctgggtgacagagcaagactccgtcttaaaaaataaaaataaaaatgttttaaagaatctaatagcaaatggggtttttttaatgtagaactattcatatgcaaatgattgccttcttattaattaggttagagatagttttcaggaactctttgagaacctaatgaataaatgaaggttaggtttattttacagcatgaaatgcaaaatgtgaaagttgaaggagacgtatttgcttagtttaaaagaaatattttatatccagaaatagatttgcctctggaaaattgaactccccatccctaaatgtatttgaacaaaggtagaatgagcatctgctagggatcttgtaataaaaaggttgccatgttactcccacacttcctgacaatcactgaacacttcatgtgatcatatctgattgaagccagccatagcaagggttgcgtctcctgagggaagatgggctagttagcctttatggtccttttagatcagtcagtttgaatgctgatgacaaggtcttctccaagggctattatatcaagtaattttaacccttgtcttcccgacttttccagattttggttcagatttattctatattttcattattctctgcatatctattcattgtacagtattctttgaatttactctttctaatgattcatttttgacaggtggatttaacagacgtttctaagtttcatagtgattatcagaggttaatctacgtttattactactgattagatgaaacaatgagtaataaatgactcacgtaatgaatacacatctccccaaagtcaaagggaataaacgtgaagcaccctttagtttgttttttcctctgttcttttgcaaggttatagttaacctactgatatgttacaaaatcatcatattcatcaaattaacatgatgttctgtagcctgaatattaaaaaatagataaaatcatgtataataagactttgataaaacttaatagatattgcaataaagaacagttcttcataacttctttttatgttacaaacctatattttaatttgtaggtaagaaggtgttttaccctgtggtgttcagtctttacaatcctgccattgtttatgccaaccaggaagtgccaccacctgtggagcagcagctggtgagactttcacattttcagttatgaaagactctaaagatcttttctagatgtttgttgtgtaagtagaaaacaaagtttcaataaaaaactgtatttccatgagcaaagtgttaaagaaaaactatagttattgtaagcacatttccatagttcctctttatacccccaataagatgcttttcacatttattgcttcagaattaagtgtagggggagcagagtttaggtcataaaggaaaacctcatgtcccagaatgtggaaattgtacagtcatttctaccagcttatttttactaatactaaaaatttgattttaaaaaccctactaactagaaattaaatctactctgctaaataagagggaatagtatactctggtaaattacctggaaagtcatagaatataaatgccatatatcaaaacttacagttattgccaaagctaattttatgtaagttttttaaaatttttaaataaacattattttataataatttagatttagagaagttgcaaagatagtacaaagagttccatacttcacccagtttcctctaatgctaacatcttatgtaaccatggtacatttgtcaaagtgaagaaattaatattggtaagttactgctaagtacactaggattacaccagtttttctactaatgtcctttttctgtttcagaatcgagtcgagaataccaaattgcttttaacataatcttttattattaatactaagaaaaagtagaaatgattaagaagtcactttaagatgtttaaaaaaatgaaaaataacttcaaggaaagtaataaaggcagaagttaataaaacaaaaatagattgagaaatatagaagcttatgtttatgtacaaaaaatttaatcataaagtagacagatttcaggtaaaaaggaaaacattggaaattagaatatgaaaacattgagataaatcaattttatagggtaagttttctaaattataaataaatgaaagatttgagaatttataaaatatgaacacaggctaagttcatgttagtattttatgaataaaagaggtgcaagtgggccgggcatggtggctcacgcctgtaatcccagcactttgggaggtcaagacgggtggatcacaaggtcaggagttcgagaccagcatggccaatatggtgaaaccccgtctgtattaaaaataaaaaaattagccaggcgtggtggcacgagcctgtagtcccacctactcaggaggctgaggcaaaagaatcacttgaacctgggaggcggaggttgcaatgagccaatatcacgccactgcactccagcctgggtgacagagtgagactccatctcaaaaaaacaaaacaaaaaaaaggtggaagctctgaagaaattaagagccatttaaaaaacagttatcaaaaagttaccctgtaggtatataaatacaatgttttaatttataagcttttccagactctcaaagagcaggtaatattagcaccatatgatgtacttaacatattttatgaggccaccattatcttcatatcaacacttggcatagtacacacagacacacacacacacacacacacacacacacacacacgcctctaccttatctataggccagtattatgaatataaatacaaataggttcaaaatggcaaactgagcacccacgtctgccatatctgacggtgaattattctgaagaaaagggtacattagtactggaaaatgagagaaggtgttagcagccgtaagtcttgagaactttctgtaagacgatagcagttagcgtaagatttctggaggagagaacagactagaatgtgttcaagagaacagtgagtgaagatggggctgctttgcatcctctgagctcatagcagacagaatggagggagcctggaataaacatgcttctctaggtgtgctgagaagcaggcatcacagggattgaccctcagtctaaggcagtgcatgtggtccctggagctggagaggctggtcggggtggctagggagcccctagactacaaaagtgaactactgttagcgcattccccctgagaccctgttctaatctccttgactgtgactggagataggccattgtaatcaaagctaacagccatggacttctgaacaatacttgaaacaaaagtgagtagcaattaaccaagactaaccaaacatttgaggaaaaacaatactatgaaagaggcaccaagtgttaatacacagaaaaattaacacatgagtatatgaatacagatagaaagtaattttaaaatatatctttgaggagattagagaaaatgttaaattcataaaacaggatttgttgctttaaaaaatcagaacttggaaattgtgaaaatatttttaaaatcagtaaatggtctgaatagcagaatggttacagttgaatcaaatttgtaaactggaagacaacccaactggacacgtaaagttcacgagataacatgagagaaaaattaagacaaggaagatcaagccagaagctcccaaattattaataggagttcagaaaagagagaatattgagtggaggaaatggaagaaagtttccagagctaagcagaaacaaatcttctggtgtttggagaacaacagtaaaaggacaattctaatagcttccagagacactaaaaatagcaaaacccagtttgttcacaaaggagtgacaatcagattggcattcgtcttctttttgaaaacactggtgttagaaaacaataaagcaatactatgaaaattctgaagaaaagtaactttgattctagaattcatattcaacctactattttaggacaaaatagacatttttgagctttcaaggactcagaatttatttctcaacagacctttgtaatcgagtccagcaaaatgataaatgtatacattgagagaggaggacctgagagtaaatagtggtgaacaaccaaaaaaattaagtctaaacatttgttgatgtaatagtgtaaatagttatgttgacataataaaaaggcaattaataccaatttgggattaagatgtcagcgggttatgtacatggtatacttatgtgtattacctagctgtcagctgagagggcctagaaccagtgacaccctaacagtaacaagtacactcagcttccaaatcttagtttctaatactattctccaatcaaacgagccagaggtccacggagaaatggttgattccagggcaggggcaaaaaatatacaagaagaccctggagcatcttacagtgccagaaagtaagaaagcactcaataaaaagatagggggaatatgtcgaaggggcacaggagccaacagaaagagctcccagtgcccaagctggaacaacctgagcaatgaaataaataacttaaacctggattataacccaaagcatcaagtaaatagccatgagtctatactgatacaaatgagtgagtgaatgagcagataaatattgagtgactagactagataggaaagaaaagttaagtcttccttacagaattccaaataacttatgtagatactccctcttccagtaggtggaactaggggactcactttcaaagaacatagtatggaaagaaaaaacaaacttttcacgggagaaacccagcagacaccttaaccaagggataccatgtacccatgacatgacataatgagaaggacactttagctcacagtcctcttccaaaaacgtagataacttccccaggaaagtcacagggaaagctgcagcaagcccacattgaggagcattgtacaaaatacctgaccattcttcctcaaaactgtcagggtcaccaaaaacaagactgagaaaccatcatagccaagaggagactaaggagacatgacaaccaaatgcaatgtggtgccctggactaggtcctagaatagaaaaaaaagacagtaaagggaaagctggtgaaatccaaatgaaatctggagttgagttaaatagtaatatagcaatgatggttccttagttttgacaaatgtaccacaacaatgtaagatgataacattaggggaagctaaaactggatgaggggtatacaggaactctctttactgttttgcaacttctttgtaaatctaaaattattccaaaataaaaggttgtatattaaaattaattaaaacaaaaagaggcaaataaagtcaacatagaagcgtgaagggaatgtaaaagcatgctaatactctttttttttttttttgagatggagtttcgctcttgttgcccagcctggagtgcagtggcatgatcttggctcactggaaactccaccttcccgtttcaagcgattctcctgcctcagcctcccaagtagctgggattacaggcacacaccaccacgcccagctaatttttgtatttttagtagagatggggtttcaccatgttggccagactggtctcgaactcctgaccttgtgatctgctggcctcagcctcccaaagtgttgggattataggcatgagccaccgcacccggccaaagcatgctaatattcttgcctggtttggagggttgtaggggaagaatgatttgaatgctgattcattctaggtgttgcatagcaacttaagtttaagcacttcaagttctagtttcaccacttgtaacctttgcaagttgcttaacttttctaagcttcagtctcctcacttaaaagacaaaaacttgttttccttgatgtttaaagctatattagaagtaaataagaaggaaaaaaatgggtaagacagttgataattcacatatttaaatagtcagccttactaggaataatttagaacagcagtataatgctttgtttctgctgttaggtcactgcttttaaaaagcaaagccatgtgagcaagactgggggatgggagctcctccgtcgcttctgttggggattcaggccagttctctgagtcgagttctaaacagattcatccctctgatccagtaatttccacccccaacagtctttcctggggaagtaatcgagctacatgatggtaatatgcataaattgataacattaaaagcaagcaaaactctaataataaaaggataaattgaattatggtacattctctggtgaatattgcatatcaaggaaaatgtgaaaaatgtaaatacagccgtgtaaatgaagaggaaaatgtaaagctaaaaagcgggaaatagcgtatctatattttaggtaacatttaaatgatgataatagctaatatttttatgaaccccttactatgtgcagggtacttgttctgttttgcctacacattaattcatttaatcctcctaacaacctctgaggtatgtagtattactgccccatttttcacagctgtgctgcagtcgagtgcctgtccaagtacacactggcctgagtaggcccaggaggctgggtgatgtggctccgcagcctccactcctgtccactgtgcacactgcctctgttatattaattcatcaaatattgagggtccctttgatgccacgcactatccaccactggcaccctgacacttagaccctaacagatatggctgttgctcgtgaggatctttatttattaggaggtgacagaaagtaaaatcagataatgcatgccacgtggatcattaaaacagactgagttgcaaagagtgactccgtggtttctgtggcttgtttggtcagaaaggtgtttctgagatgaagctgagcagagctgtccaaagaacaggaaagaaccagctaggctgtgattgggggatagtggtttcaggcagaaagaacagctactgggtttcctagggtgtttggagcacagccggtgaggggcacatagctgggccagggcatgtagagcttgttcagcctctggaaggcattgggattttatgctaagtatgttggaaagcctttggagggagaatggattgtgtgtggctctggctggcagcagccagttaggctttcacagtagacaaggggagatgattgtggcttgggtgacagtgtattataattacggagaaaggtttggatatgattcagagatagggctgacagagcttgctgttggattagatgtaggaaattagcaaaggaaaggaatgggagagcagagattgggattcaactggagccatagtagccatgtgttgtttatcagacatccaaggggaggtgccaaattgctagttggctacagggatctggcattctgtgagaggccaaggcttgggtatataggttatgtgtggataactgcatctcccacatgcttaggaggccagataaaacagtgcaagaaaatattaacaataaggattatggacaatttgagtttccttctactttcctttgtgaaaatgtgttgctttaaaaatcaaaccaatgattcctttttccaagtctgataatatttgaagaatttttagagaaactaagttacaaagttatagtacttatataatcagaattggcatggtgtagagatgtcaaagtgggtgttttgctttttaatactttgtatcagggttatattttaacaaagagataagaatattagagacaggagtggtggctcacacgtgtaatccgagcactttgggatgccgaggtgggtggatcaccagaggtcaagagttcgataccagcctggccaacatggtgaaaccctgtctctactataaataccaaaattagccaggtgtggtggcgcacacctgtaatcccagctgttcagcggactgaggcacggaaatcgcttgaacctgggagctggaggttgcagtgagccaagattgtgccactgccgtccagtctgggcaacacagtgagactctgtctcaaaataataataataatagagtctagtcttcattttgccactaaaattatgtctctctatatatttatttattcaacacgtatttattgaaagcttgtcatgtgcctggcattgttctaggtgctaggaatatagcagtgaacagaatccacaagtcctcccctcagggagctttacattctagaaggggaagaagttctccccctcagctcaaaaaaaaaaaaattgaaaagaaaaatgccaaactcatccatcagctccaatctgagctgagccctcagggctgcctggttcattatgtgttttcctgttgattctcctattctgtacagcagcaatttcagactgtgcccactcttctcaaaatttgtcacctctgcagaccttgatattcctgctatctgcaggaatttctgtgtaggtgccttacagatcactcagattcattatggccagaaccaactccatgttgttcctctctgggctggcccttcccctgggcttcatcttagggatagcaccattacatacccactgttcaggacggaagcctgctgtcatcttggttgatccttctccttcactccccactcctgcccattcaatcacttgctgacttctgtgaagtctctgacctaaatcttttccacattccacatccatacactcttttgcttttggtacataccacagtagcacacactagactagcagcttcccatccctagttatagctgttgcctcttttctttgtagcatgtatcaccacctaaaatgtatatttatttatttactattttcccacccaaacaaaggcgctttgatggcagggactttgtcacctctgtttattgctaagcctcagttactagaaccatatccaaaagattaaacacttgttgaaagtatgaataaaataaaaggtttatcaggcttcaacttgtaagcagaagtgattccaaggactcagtgtcatcaatgccctggttttatatttctttctctacttagacttaagtggtgacagcctcatattaaagctggtttctcgcatggtagaaaaggactttggcagttccaagcttcatagctgcatcgtgcactagaggtcaacaaatgttttctgtagagagccagataagaaatgttttaatctttataggccatacagttctgctgcaactactcaactctgccactgcactgtgaaagcacccatagacaatttgtaaacagatcaacacaactacgttccactaaaattatttactaaagcaggcagcaggccagatttagccagaggccatcgtttgctgaccctgccctacgaccaaatgtcctttctagtgagtctcttagaagaacgaaggagctttgttttccaaagttcccaacaaccaccctggtttacctacttggcctgatttttttttaaatacctattagtgagccagtaagtaagtgagccactatggtaagtggggtgagactgtctcactagtatagagactcatggcccactccgaatctactggtgacagcagcttccctgaattcatgggctgcccagggccaggtaattaccagaacaaaactgtaccaatcaggaagggggttgggggaatggatactgggtaggcaccagataaagtctactgtgtaaggttgatcctgtgtgttacaatttgtttatgcaactgttgtcctagaatgtaagccccttgaagtcaggcaccacaatgataattagtaacctcagcttgcaccttgtacaggctttgagttctatttttatttgttttgtaaggatttaataacataagtgcatgtgatccttaatcagtcacataaatgacaggaaaaaagtatacattagaaaataatttgtttcatcgttgattaaaacttctgcttcttatggaattaaattgttttctgtttttttttttttaactaaggttcacaaaaaggattctggcttttggcgagattttggctttggaatgacttgtcagtatcgttcagatttcctgaccattggtaagtatactttacatttaaggataggactttatttactccagacttaatggtattttgctaaaaggtctcagatttgagtgttttcctactaaagtatgagtgtctaaggttagctaaaaagagaaactggatatacaaaaggcaaaataagtttataattaatgttttgaataggaaaaaaatggtcataaaaataaagtataatatttacttgttcctttaaaatcaaaacacctgtttttaaaaatatctgtttaacttgttacccatagttgcaggtgtttagagtagtcttacaaaagctttctctataactttactgttgtgcccatgggttgttacagctgggagtaatcttggttatctagaccaaggactttcacatttttttgagatgaaacctcctttacttgtctagtgaactgttacacaaaatcccagtatttaatacaaatgaaagaagacctgctctttctagcgcgtcttggaatcacaccttagtcatgcattcccctaagcctaaagatggcccatgaataatttgttctaactatcctgcatgctctgttgtccaggctgaagagcagtggcacaatcttggctcactgcagcctctgcctcccaggctcaagcgatcctcctacctcaatccccaagtagctgtgaccacaggcgtgcaccaccacacccagttaatttttttgtttgttttgtagaggcggagcttcattatattgcctaggctggtcttgaactcctgggttcaagcaatctgcccaccttggcctcccaaagtgctgggattgcaggcgtgagccaccatgcccagcccctagcttcagtcttacccagcaaaatataaagtgtcaaagaatagtttaataaagcaggctgaaacctgattccatgtcttctgattcatttagggctagctacctttctacagcatagaagtcatagaatatattttatatacattctaggtccatatcacattcgtttttataaccagccttttgttttggaaatccccccaccttgtctccttatcattgtaacacttgaataatggaaaatcaggaaataacaataaaaggggcgttaaattaaactgatgctcttttccttgatttcttgcttagttaagcaagcagcatttcactattcctcaaaaatagatttgtgtacattttttcagtatcttgaatgctttgagttccttatctcttttttatgacaattttattgagatatagtttacatatcataaaatttattaatttaaagtgtacggttaaccaggtcatgtagctatcaccaccatcaaatttagagcatttcaccccaaaaagaaatcccatacccattaacaatcactcctcacatcctaccaaccctctttccccccaaacttaggcatctactggtctacttcctatagatttgcctcttctgggaatttaatagaaagcaaattgtacaatatgtggccttttatgactggcttctttcactcacataatgttttcaaagttcatccatgttgtgacatgttaggtacttcattcctttttatagccaaaaaatgttctattgtgtggttataccacattttgtttctccatttgtcagtttatatgcatttgagttgtttctactttttggctattataaatactgctgctgtgaacatttgtgtttaactttttgggtggacatagattttcaattctcttggacatatgcccaggactctggctgggtcatatggtaatcctgtgtttgaccttttgagaaattgccacaccgttttccaaagtggctgcatcattttacattcccaccagcagtgtttaggagttccagtttccccacatcctcattaatacatgttattatctttttgtttctagtatcacccatgatagtggatgtggtattgattgtgactctgattataatttttcttatgattaatgttgttgagcatctcttgatgtgtttattggccatttgtatatctttagtgaaatgtctgttcagatcctttgcccattttaattgggttatggagtttcttgggcttcttgaatatgtacattaatgtttttcatcaaatttgggaagtttcagccattatagtcatctctcagtacctgcatgggattggatccaggataccatgtggaaccaaaatccatggtcgatcaagtcccttatgtaaatatacatattttcatattacctgtgcatatctgcccatatactttaaaccatctctagattgcttataatacctaatacaggccaggcacggtggctcacgcctgtaatcccagcactttgggaggccgaggcgggcagatcacgaggtcaggagatcaagatcatcctggctaacaaggtaaaaccctgtctctactaaaaatacaaaaattagccaggcgtggtggcaggcgcctgtagtcccagctacttgggaggctgaggcaggagaatggcatgaacctgggaggcggagtttgcagtgagccgagattgcaccactgcactccagcctgggcaacagagtgagactccatcaaaaaaaaaaaaaaaaaaccctaatacaatgtaaatactatgtaaatagttgttatattgtatttaaatttttatatttattgttattttttatcgtttttttccctaatatttttgaaccatgttggttgattctatgggatgtggaactcatgcatatggagggctgactgtatttctttgaatactttttctgctccattctcatagttttctcctttgacactcactgtatgtatgttggtacatttaatggtatcccacatttttcttaggctctgtttatttctcttcattcttttctccctctgttcttcagattgcataatttctattgatctatccaagttctctgattgttttttctgttagatctactgttgagctactctaatgaatttttatttcagttactatagtttttaacttcagaatttctatgtggttcttttgatatatatataatttctttattaatactctatgtgatgaaacattgtcatcttctgttacttccttaagtgtgacttcttttaattctttgaacatacttacaatggctgctttggaatttttgtgtattaaagctaatgtctgggccctaacacaggcagtttttgttgcttgccggttttttttttttttttaagcgtatgtcacatcttcttgtttctttgcattcctcattatttctttttcgaaaactagacattttaggtaatacactgtggcaactctggatactgatttccctctaccaccacggcttggtttttttttttccttgtttatttatttattgacatggctggactattttaacaaattatttcttcctccttccccgaccttttggcaatatgaagcctctgctgttgctcctcagggcctgtgcagttatcctaggatggcattggatttagcagggctctctttatctctttccatgcctccattggtatcactcctattagactccactgactgttcactaattgctgtcttgtttttgacaatgctctggggcataaattgctccataatctgtccctactaaattgggcccttttgcagggatagtttttgcagcaagtctttgagatttgttcagaccccaggaggtatattcttactatctctctctgtggttctctctagtaaattagctggcctacagtttagctgttgccctcctggagttaccagcctcctcttaattgcttactaccaaaatctccattattttcaagaggctggaacttctctaaactctgaacttctctacattctattttaaataaagtcagttccttagggaagaactttggagcactttgttcttatggacttcctctcccccgggggaaaaaatccatgaggttttgccctgaggatggggacagtgacacacttattaagcagagtgaccacctctgccctatgagcaggacactgggtaggggcaggaggacccccagtattctcagctggccacacctggaagtggagcctccaccctgttgctgtgggctgggtgaaaaagagctgcacctgtttagaacttagactctttatttggagcttctgttcccttgtttcctttcttcctggtattcccattatacatatgttacatcttttgtagttgtcccaccgttcttagatattttgttcattttattttcagtctttttttttctttgattttctgttttggaaatttttattgtcatatcctcaagctcagagattgtttcttaagctaagtccggtctactaatgaacccatctaaggcattcatttatttcgcagtgtttttgatctctagcatttttttaaattccttagatccatctcactgcttatgttccgcatcttgtgtgttatctgctctttccattagagcccttagagtattatacatagttgttttaaattcccagcctgataattccaacatccctgctgtatctgaatctggatctggtacatgctctgtctgttcatactgtgtttttcttaacttttagtataccttgtcatgttttctgttgaaagttggacttgatatactgcgtaaaaggaactgcaataaataggcctttgatgatgtggtggtgaagtgtggagggagcggaagtgttctgtagtcccataagtaagtctcaatctcttagtgatcctgtatcccagactctgaatttcacacatgcttctcagtctcccctcctctcctggacaggatgactagaaggggctctagttgggtagatttcttcctccaagtcagttaggcactgataaaaccccagcaggttaggctctggttaaataacttctcctaaggacaggctttgttaataatgacaacatgctgtggcatactttaaaatgattaccttttccccttccccactgctggacgcattaagagatttttctctgatcttcaccactgaggacctaatagagctcctagaggtaaaactcacatgagtatgggggtcccaatatgaccaggtccccctggagtttttaacactcagacttacctcccctgagcctccagcaatttgtcgattacagttagggttttcctacctgggtactggtccccacagagatttctgctccagtaagttggaattctttgtatctgcctatctgtctcaccagttttgagggcagtggtttaccctgtgacctcacttctctgtgagagacctaagaggagttgttgctttttcagtgttcagcttttgacttgttaggatggagtgatgacttctagctccaggcatgccagaccagaaactgagaatgccccatttgttttaagtatatgtaccatctctaatattctaagagcttatatctacaaggaagaaaagctgatatgtatcagacatagcatttagtaaagctctgattgtttaatacttttcagagatccccagattattgtccatcctgttaatgtgaaattaagtgggatagaattatttgacaggagccgggcatggtggctcgaacttgtggtcccacttactaaggaggctaaggcagaaggatcacttgagcccaggagatggaggctgcagtgagctatgattgcacctctgcactccagcctgggcaacagagtgagaacacatctctgaaaaataaaaattatttgacaggccaggcacggtggctcacgcctgtaatcccagcactttgggaggccgaagtgagtggatcatctgaggtcaggagttcaagcttacgaagatgacgggattaagagattaaagtaaagacaggcaatcacaagggtattgattggggaagtgataaatgtccatgaaatcttcacaatttatgttcagagattgcagtaaagacaggagtaagaaattataaaagtattaatttggggaactaataaatgtccatgaaatcttcacaatttatgttcttctgccatggcttcagccagtccctccattcggggtccctgacttcctgcagcagcccactccagttagccttctgccccatcactctatcagaattgttctggggaagtttataagtaacatttatgctgccaggtccagtcagttcttcttaaattcttcactgaatagcacacacttgacaacttcttcctcaagacactttcttcacgtggctactacaatggcaccttttccagaattttctccctcacctggggccacttctcaatctcatttcctgacttaactttctttacctctatttaacctctagaaattggcatttcttagtgtttagacctaggccctgttttccttccaaattccttcagtaatttcattcattcctgtagctttaaataatctatggacccattctcaaatttatatctccagcttggccctttcttctttttccactctggggagtttttctatagcccagaaaagcgtgtgtctcaaaggacagaaaatgtggctggtcgcagtggctaatgcctgcaatccagcactttgggaagccaagtgggcggaacacttgaacccaaagttcgagaccagcctgggcaacatggtgataccccatctccaccaaaaaaaaaaaaaaagctgagtatggtgacatgcgcctgtggtcccagctactcggggctgagatgggaggatcgcctgagccacggaggtcgatgctgcagtgagccatgatcacaccactgcactccagcctgggtgacagagtgagaccctgtctcaaaaaaaaaaacaaaaaaaaaaagaaaacataaaaagttaatggtggtgagattataggtgacttgtattttcttctcctttatttgactttttgtagattttctacaggactttgaaatttacaaagtgttcttaaatatttaaccccattttgatactgtcaacaaccaaccttgagctccttgagtccaagtgtcagctcaaaactggacttccggtgactgggagtcactcctccatgccaggtgtctcgtgctacctttttgctgaaccatcccatcccttttgaagcagaacatttaaaattttatatatatccctgtgctctggctaataataggcagttatttatagtgtcaattttgatcttacaggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagtttatttgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaagttaaatgaaaatgtgataaatttatttctattgtaaagtatcataaagacagaacattacgtataacatgtaattgtgtactttaaaaatgaaacacgagtgccgcagctgttcacgttaaaatatggggcattaccaggggacaggccccttgtgccccttcttgatcacctgtgctcaccctctccataacagtcacactctgatttttatgatcgtttttacttgtttttcttcttagttttcccagttacgtatctcccaatagactgttttgcctggttttgaatttatatacattattatttcattatatattctctttcattcagtgtttttgaggttcactcatattattctcaaaattagttcatttttattattgagtagtatttcattgtactgtagggaggggaaaaactccctcccatcttctcagggtcccagctggccttgaagattaaattggcataggatagattaacaagagaaaagcatataaattgatgtaatacaaattttatgtggtgcaggagccctcataaagaaataaaaccaaaagaagtagagtcagttacttacatactgaattggacaaagactagtaaactgtgaaaatgtgactgtattttgcgggagccttaaaaaatagttattctaacaaggtctgtacaatattctcctggtctcaaacttctcgtcattgaagataaagatgtttgttgccttttcttccagtatagagagtgtctttcacactggaatccatctcctgctcttaagaaacagcacaaaggtcaatcacctttttgcacctgctgtttttcatgtgtctttaatttaaatagtatgccggaatggcatattttaaccccttcagtatgaatgtactactatacttcttctactgttactagatacttgggttgtttccaagttgtttttatattctcttgttggtaactatttgggttgtgtagatttttgtggtttgcttttgctgttgcatgcgtgttgtcgtgaacatctcctgtaagtgtgccagaatttctccaggagtaaaaatgctgagccatcggttgtgcacatgtttaactttccaaagtggaccaccttccaccactgggtgagttcattttgcatccttgacagtacttaattttgtcaggcttattaattcttgccaatttagtgggctttaggcatgaactgtagttatgatttatctccagtctttttgttcatttttaccagttcacagggattcttcacatattccggataccagttcttgttggtttaatgtttgcagatatcttctcccatcaagaccaatgtggtttgtcttttcccatttttggtggtactttttgataaataaaaaactaactttattgtgactatcttttttctttatgatttctacttttttcaatagaatttattttttagagcaattttaggttcacagaaaaattgaacagaaggtacgtggagtttccttagatccccctgcccacacacatgcacagttttttctgttacctacatctgtcaccacagtggtacatttgttacaaccagtgaacccacattgacacaaaataatcacctaaagtccatagtttatgttagggttcattcttgttgtacattctatgggtttagacaaatgtataatgacatccagtgttacagtatgatacagaacagtctcactgccccaaaaatcctctaggctgactattcatctctccctaccctctaacctctagcaaccactgatgttttcactgtctccatagttttgctttttccagaatgtcatatagttggaatcgtacagtatgtagccttttcagattgccttcttatcttagtagtatgcatttaagtttcttccatgcctttttatggcttgagagctcatttctttttagtaatgaataatatttcattgtctggatgtaaccacagtttacccattcacctactgaagggtatcttggttgcttccaaatgttggcaattattaataaaactgcaataaacatctacgtgcaggtttttgtgtggacatgttttcaacctttgaacaaataacaaggaacacagttgctggatcatatgataagagtatgtttagcttattagctttgtaggagcgtgccaaactgtcttccaatgtggctgtaccattttgcattcccaccagcagtgaatgagagttcctgttgctccacatccttgcaaccatttggtgttgtcagtgtttcaattctggccattctgtaggtgcatagtagtatctcgttgttttactttacatttacctaatgacatatgatgtggagcatctcttcatgtgcttattttccatctgtatatcttctttttttttttttgagacaaggtctcacactgttgcccaggaggctagaggctggaatgcagtggcgctatcatggctcactgcagcctcgacctcctgggctcaggtgatcctcctgcctcacctcctgagtagctgagaccacaggcatgcaccacctgccctggctagtttttttttgttttttttaatagaaacagaggtccccctatttacccaggctgatctcaaactcctaggctcaagcaatgtgtatcttcttctcaagtgatgtgtattttctttaatgaggaattggtttctactttttattgatttatgacctcataatagggaaggatttctttaaaaatactgttgtatattctcaatatctcccatgtaatttcacttttctcaggtctttaacctaagtggaagagatttttgtgtatgatgtaggtaaggattgcatttcacttacttccagcactacatccatactttacctactgatctgcaaaaccattcttatatccatcagatgtccctgtgtgcatgagtctgattctatgctctcttctgttccgttaggctaccactctatcactgcaccattagcattgcatggtatcagttactgtaattttatgctagtgaatatctgggacacattttccactcaccttgttcttaaagatcgttatggctatcataggctttgtactttcatataaattttagaatacgcttattaggtttcataaaaatgtatgaatttgattagaatatcattgaatctgtaagatcactttggggagtctttatgatatgaagtctcccaatctattctatttggctttattgtttttcaattacattttataatttttcacactgtggacttacacatgctgtttttcagattcttcatagttactctgcatttttgataccattgtaccttatcttttattgtgttactggtgtttagaaatcattgattttgcatgttaatttttgtgttcagaaactttgccaaaaactgttaattctagtaattagaattcttttgcatttttcttgttttacatcatatcatacatatgaatagtgagttttgtttcctttccatttttaggtctttagttctttttcttgtcctcctatgcttggtaggatttgttgtgcaatgctgatggaagtggtaatagtgggctccctgccctgtttctgatttcaagcagtgctttcagggtttcatcagtaagtgtgatgtttgctggaggtgttttcgtagacaaccctgtcaacttaagaaacttcccttctgttattacttagtgagtttttatcctacctaagagcatttatcagatacttttactacatctgttgagatgttcatatactttttcccctcttttaaagtattaaattgatgaattaatagattttctcaagtagctttgcattcttgggacaaatgccagtcagtcatgatgtgttatttttattttacattgtttgatttggtttgctttcatatacatacatgtaagtattcacatttacacatctcatatgtattcatgtcgggggtgtgggtatgtatatacttcaggtgtttttaatctatgttcatgaatgagattgcctatgacttcccgttctcttccttgttgggcatttttgtttatttatttgttgttttaattgacgggatcttgctctgtctccaaggctggagtgcagtgggggcgatcatggctcactgcagcctcaacctcctgggcttaagtgatccccctacctcagcctcccaagtagctgggaccacaggcacacacccctgcacctgactcatttttgttgttgttgtttttgtttgtttgtgtgtagagacggggtcttggtttgttgtccaggctggtctcaagctcctggtttcaagtgatcttcccaccttggcctcccaaagtgcagagattacaggtgtgagccaccatgcctggccctcattaggcttttctgttgaggttatactagcttataaacttaagttacaagtgttccttcttactctgtttctagaaaagttttgtaaaattagaattaatttcttccttgaatattgaactgcctggaagaacggcctgaaagccacttgggcatgaacttttctatctaggaagatttttgatcagttgttcaatttatttaataattatagaactattcagactttctattgtttgtagaataagctttcattgagttattttgggtaaatcataattttctaggaatttatactgataaatttgaaaattcagatgaaatcaatatcctcctattatctgtgtgatatgtatacgatttatagtgatatcctttttttctcattcctgatatacttatgccttctattttttcttgatcagctttgccaggagcaggcagatttttttcaatccttttaaataacccttaccagccatgtatgagagatcagttgctttacctcctccccgacacagtatttccagtgtttttaatttaaactctttaattataatttctagtgggtgtgtacagttcttattttcatcttagtttataatcagggaatgatgtcaagtaccttatcatatgcttattggccatttagatatcttcttttgtgaaatgcctgttgaagtttttctgccttttttaaaaaaaattagtttgattttttttttagttgatttgtgggggttacttctgtattctgaatttgagtcctttgtcagatttacatattacacataccttctcctagcaacagcctctctttcactatgttaatggtatctgtcagtaaacaaaagttcttaatttcaataaaaaccaattttcttttatggttagtgattttggtgtccaatttaagaacctttcctactccagaattttttttaattctttttttgacacctcattgcattgcctttcatatttaggtctgtgatccatctggaaatcgttttgtatatgggttacaggaagagtcaagatccatcctttagtttttcttttagggaaggtctgtggatagcaaacgccatttagtttgtctgtaaatatctttattatctctcatttaataaatagttttaaaaagtagagaattctaaattggctatcattcttctttttagcacaatgaagttactattccactgtctcttggcttcagttatttctgctgtgaatcatcagcgtaacagccatcatccattgaaagcagtccactctcttcttttctgttctgtgtcactatgatacatctgcatgtgggtttgttttttttctggtcctgcttgagattcttcgggttccttggattgttactctgaaaaattctcagctgttttattttcaaaaatgattcctgcctcattgtctctttgcttctctaactctgataacatgttaaaaccgttgtgtcctccatgcctcaacctgtttcttgttttccaatgctttattctgtgttagattctgttaatttcttcagaattatgatcagatttggaaaataaccaaatagagcatctagaaatgaaaactacaataattgaattttttaaatccagcagatgggttgaacaaaattagacacagctaaggaggttttttttttttttttttgaggaggagtctcgctctgtcgcccaggctggagtgcagtggcgccatctctgctcactgcaagctccgcctcccgagttcacgccattctcctgcctcagcctcccgaatagctgggactacaggcacccgccaccacgtccggctaattttttgtatttttagtagagacggggtttcaccatgttagccaggatggtcttgatctcctgaactcatgatccgcccgcctcggcctcccaaatcctcccaaaggattacaggcgtgagccaccgcgccaggccctaaggaggtatttttttaaaaactggaatataagtcagaatgtttgtttctactggatgtttaggggcagtaccagttcagggccagttcaaagaattcttagcttgaagtttgttggaccagtgttgatttgtgctgcaaaattttgtgaagctcactgactcatcattatcaattatgaaggtaaaatttccctgcctccattcagtgctgagattcaaatcagggagcttttcctaggtccctcggtggggtttgggtggagcgccttatttcaagctcactgctgcaccgaggggtggctctttgggatgccagctttatgggctggggtctcctatttgattcttcatcttgaggtgggccctggacttttttctctacccctgtggacttgaaaacagcagctcatggtccttaccctcagggcaaagcaggctgcagagcttccctgacttctctggctccctgccttcacttggatttttaaattttgtacaactttatctgttgttttcagtgggcacgcacttcatctctcacactgccagaaatgcacaagtggcgcagtttactttcttacactcttccctgcactgttgctgaaccactcagccctgctgagcgcgcctgagcatctgcacctgagcatcctggtgctgtgggtagatacttgtggggtgttcagcagcccctcaccttcctcacagtatcctgacttccttgttgggaataaagattgaaattgtgttaacgtggtctaaactggcctgcagatggattgtaagttttgcttcttgaagttttgaatgcaaatttgtgggaattctttcccatttatatttttatgctggttggattgaacagtgactgttaggtgaacagtgacatgttaggtgaatgctaacatgcttcgtattgaccaggaccccaggtgttcctttgagaagggggcctttgcttcacttttcccaaaaggtgctgtggccttttgcagaagtgctgcttggcgtccgcagcaccagggccagtccatagcaagcaccgactgtgctgacaatgaaccaggtgcctgctctgtctgcctttgcttcttagaagcctttgcttcacttttcccaaaaggtgctgtggccttttgcagaagtgctgcttggcgtcctcggcaccaaggccagtctacagcgagcactgactgtgctgacaatgaaccaggtgcctgctctgtctgctaccacggccctgcaagagagccgtgatcagatgaaaaacatggaggctataaggtaaacagcttgtccaagcttctccagctgggggctgaaaccagctctcactccagtttccccggctccttgctccctccctgctgccttgtgcctccctgaggagcagggtctatgttctcgtatgggcgtggtcggtgtgtgtcacaagcagtgtgtgtcacagaagtctccatggcttactacagatccttagcttatcattctgctacatctgacactctgacatccatttgttcctgcaacgtttgtgaagggtgacactcagccatcacacagggatgtactggtcacaaggcacacagactatcacccaccgagtgcttctcacacgtactgtgtggcccagggattggactaggcccccaccgtattgccaattcaggaggtgtgtggagaggcctaagaatggacattcaaacaggttcccaaggacccacacttgaaagccactgccctggaggaactgcccatggcaggggatggccctcccagctcgaggttgtatccaaggccagagcaaattatgcactcccccttcttcagctgaggcagatgaacacttccaaaaataacttcttcaccaggaaattagggatgccattggatttaaagacctaaaaaatgtcattcactaaaagctcaagcatcatctccatgtccccatttgctccacagacacccgagcacctgtcctgcactgcccactgcatggggtggcaaggccccgaggcccagcttctgtccaacacgggcccctggctgtccaaattcacatcccaaattcagcccctgggtcacactagccacatcccagcagacaggacccacatatggttggcagctgctgtactggacagcacagatacaggacattcccttaccccagaaaggtttctgttgggtggcgctcacctcgtgggaatgatgacactgagcacatagtgaaagatgagctgagttatccctggggtgcagtccccaccctgtccaggcctgagaaccgtgggaatgggcaggttggaggagcagaggggagtaccatgtcctgttctggagccttagtttttttccttcaattcccgagctctcatgtgctcccccagtgaacccctcttctctgttgcgcttgagtataaaactcatgacaccaggagtggcccctccagacctgcattctgcaggctgccctgcaggatcgcgtccaggggctctccaacctcccctgcccccagagaggccatctgactcctctgcagtaacacagtccatacagcctggcttaactaggtatcctgaacttacttacttatgtgaccatgcaatacagcagccagtgacatctttttggagctcacaatgaggaaagcaggactgaacgtgcctcctatagcttctttcgagtctcaccttattcagtggaaagccctttgtcacacaaagtgttgccagctggagacaaaagtctcttgcccagtccctcctgggaaggccacagcaggcctggcagcctcaccctcctccctgccccaggggacccatgtctccggccagcagcaaggccaccccctcactgtacacacacagcaggcaagggaggggagtgatgtattcttttattgaagcaagtatgtccagtcacaccaaaactgacgtcctgcattatggtacagcttcatactcagagttcatctcaaataccaaaacatcaaatcagggtatgtatcaaattgggaaaataaagtagcagacagacactgtttcaagtaggtactagaactgatcacccgtgaagtgcacgtgggtgtgtacagaaaccgttctaaggctgtattccaaatatatattctcaagttttaagcctttctcatctcaaagacataaacaaagcaatatgtactatcaatatacaatctgtactagctagaacctcagaaagtgcaaacacactgtgacaatacagtggaactattcctgctccacccaggaccagaggcatgggcagcgggcccagggctgcctcctccccaggcccagcctttcccaatgtcttcaggctcttccaggagctttgggaattgggacctggcccatcctcacccaggcttccccattgatcaaggctcctgcggaaactgggaatgcagagggacaaggatgcggagttcctgcgagggagacggtccacgtggattgaccgtgtgctttctgaaggacagctgtcctgcgccatggtcagtagggcccagggctcacaccacgaagtcagacatgggaaaatggagtgtgctcctctagctgggtgtagaaaacacctctcagtattgggcagttttatctgaatgggctccagcagtatggcctggcgaattttctgtttccaattccaattagggcgctgcctacccaggtgggaagagggctgttggctgccctcccctctgtagatgataggtttcaagactagctctaaatgtcaccaccctggagtcggccatgtatttttcttcatcacagctcagtgtgtctttcagtcacagcccagaaaactgacaactccatgcttccctcccttaccttattttagatttcctcctttctaaaatgtagttgaagaatgatttgctggacacattgtcacagaaaatatgctgccaggtgccccctgcccctccctgaccccacaaatccctgaaaggaaaatgaaaatgtaaactttggacagcccgtactcaaaggctcacttccagaagtgtgcggacgcgacctcccagccaccagccctcctatggagcctcgcagcccaggctcctgagggcaggcgcccaggtggagtgggactcaccgcagcccaaaccacagagcaggaagaccagaccccagtaccctctaaggcactaaccccgacgtcagagacactggctggaaaggcgtccgagcaggcagggctcacgttggttttggctgggttttttaaaatatttttttcataagatgttaataatcaaaagtagaaaataaaaatctacatttcattagaataagatgttatcatggataccatctcccatgatactctcccctccccctccccaaagcagggccctgccctgttatttaaaataaacaaaaaaaactttgtaagtgccaaaggttgatgcgtgaaataattaccatttttttctcataaaagttatatacaaaatggaccccaaccagtgaggcctcctcatctcaacccacatcagtcaaaatttaaacccagttagtgcacgtgcttcctctggcgtcgcgggctgcatccgcctcaggctctgttcagaagggtggtcctagagggggacaggacaagcagtgctcaggcccgagcagggcggcttgggtccaagccatcctcagcctcccaccaaacatgcaccagggaccctggaccagggacgcggcagtgcccaggctccctttccaggagggtaaccctcgtgcccaccctgagtcctccctcttccttacagactcccatgttcctgacgccctcctacctgagggtcttccagctgtctttttccatgtggttctcgggaccctcactttcaaaggaggcgacgaagagagctgagagatgggaaagtccctcagagcctgtgtccccatgcagtgtctgcctgaacccagctgtcccttcaggagtacagcccagcacaaggggacagtgacctctggctgggctgaacacagttctctgctgtgcggggctctcaggctgcctgttggggactctaggaaggttcctcgtgttgcagcacctgacctaagcccatgtgaccctctccagtggctgctggaaactgagtctcttgtccttctcttccatccatcccatgacccaccctcatgcacactcgcccctgcgagcagagccagccctgtgtggcatggagcagccagcaggccatctcccagggcaaccccaaagagcaccgggcctggacaaggagtcaggtggggtgggaggcatgctgcgttgggaggcagccctcaccttcctcgctgtagatgggcgccgtgagcaggtaactctgaatcttcttgtccttctcgaaaggacactctacctgtgtccatgtcatgaactcatggatctgtctggagatctcccagaatttctgaagggagcaaaaccaactgatgttcatctgtcaccttaagcaccaaaccctcggtcagggcaggggacgtaggttttggcctcagcctcctgctcacttcactggtcccagcaagatgggacagtggccctgcacgctgaccccgtggccatggtggcacgccatgcagcctcagagccagcaggtgtcccccaaggccactctgtctggccctccacctgggccatcaggccggcagcagggtctctgcctgtctgtgcagggacccaaagaaggccccactgataactccagcctgaggcaggcaccccatccaaacccagcccagcggcgccaaccagaacgtgtcatgatgtcccttctctgggaccttcggaaggatcccagctcctgcccacacctcacctgtgtgaggtaggcatccggcagcccacagccacctacacctgccctgccacctatgtcccaccctcccatcctcaccaggtgccctcaggcccacgaggcaggctcttcacttccatctagaattctctgccgcctcctccctgctcaagtcccttcctatctaaacccctcctgacctccaatcccacaggggtggacagggctctctccctggtagggccaggctggaaccacggtcctggataaatacaattccctgtgactccaagctctgcaactaggccatccacccagaagtaccggcaggcgcacctcataccttgcagtcaaacagcaccccgtgacccactatgaggctttcagtcttgaaggcccttgtgaacctcaggcagggctcaggaaacccacagatcccgacccagggctaatgcctggcggctccagtagctcagacagtttccgcctggcctgccctgtgctgggatgagctcaccttaaagttaatgtgcccgttgggcaggtggttggtatggattttgtgcaggaagtagatgtccttaacgaagaggttgaacacagggatgacgatcttttcacggctgctgttggccatctgggacctctgcgtggccccctgcagggctgtacggtagttgcagaagttgctggacgggtccatgtgatgctgtgggcacagggaggacctggtgagcatcacagccccatgcccctccgacctgctccagatgcccctctgcagagcaggaggcagcagacagagaaggcacctggcccctgggcagcctgggagttagcacgggggaggggacgcccaagggtgcctggctgagccctggggccagggcttctgagttcaggtcctggcatcctctggaaagccacagaagtgtcactgccctgcctgccaggcctgaccctcgccctccttccttcaagacttccctttgctcctctacttagatcaacacctcccagacctgaccagctccacaagacacatgctttgcaaaaatggactctgtggtcaaacacatctgaggaaggctgcaggtgaccctgtctgccagcctctgggccatctagaccagccaggacctggagacactgaccaaggaaaaggcagtgtcttccaacacaaccccactcttgtcaaactcttgcttaaccgcattccactctggaactcgccttaggtgatgccgggtctgcctgaagtaaccgaggacaacttaagtccccactgctggaggacgaacatgccaggccagctcagccagcactgtaggtgctagccccagggagaggagggcagccccccacccccactgtcagggcccccttcgggccattgcgggacgaaatgggtgcagctcgcagctgtgacggggctcaggtgcctacctccaagacatcaaacttggctgtcttgaccttggaccaagttttcttcagccttgccacaggactgaggttcatgccagctgcagaggacagcaggtagggtcagggccgggggggtgggccatgcagcagccccaccctgggtgcccagtcactcacagatgatggccatcatggagttgaagttcccgatgttgaagcactcccgggccacatcaatgaagaactccaacatgcgggtccggtgtttcttcttcaccacctggaaggtggcaggtgacctcagcatggcgctgccgggggacagcaggagctggggccgccgggcagaggaacagaggggcagggaggacctcgggacttagcttctggccacagcgggctgatccaggtccatggctgcgtctgggaggtccagacatgtgcacggcctatgctcaggctcctcagtcatcaaagggaaggcaccatctgccccagagggctgtgagggctggcaaagcctcacacaggcaagaaaaatggtgctgggcacaaggggagcactccacggatggggtgtctgttgtcattgaaggaatcgctgtatgtcggggttgggggaccaccaaggccctgacaatgcaacagggactttgtgcattcactcttaaagttccatcatctaattcctggggcaagatcagggtctcactgggtgtgggcatggcagccaccccaccatgtctgccatgggcacttacccggcacacctcagtggccaccagcatgctcaggcagttgaaccagttgtcataggcctccaggctgtaggtcttggtcaggtcccctcggcactggaaaggacacagcaggtcatagggggcctggaggaccatggctggacaacttagtccccacagctggccctggtccccagctatggctcagcctgcaccgcagcagcctcaatcatgcctgcgtgctccttgctgcccagtgcagggctggcaggccaggctggctccctggcccaaatctgtgacctctcccagcattcatcatccatgaccagcacagccatcttggagcaggtgctgcctcttgaagcaggtgctaggaggtccagtgccacatccatcggggctcatggcccagcactccggagacgctcggggcgtgctgagtgaggcccacacccaccctgcatggagcgcaagtgctgggcagacagggctggcaggggtgccacaggccttggcccacttaccctgtggttgtccaaggagtccatgtggctgacgatctgcatcaagtcctcagggtaaatgctgctgaccctgtcctggggtggaagatagcaaagggaaggtgacaagcttcccctggagaagggacagcactgcataggcatgcggacagggagaggaggagctgcccagggcacaggaccttcacctcctcccaggccagtcctccatcctagggccactgcagtccccactgcaggacgacactgctccagctcctcccactgacacagcactgctgtgttcctgaggacgtgagtgccaggcacagaggtgcccgccactcagacggacacacatctggcatgaagtgtggcagtcagggctggcaagcgcacttccctgatggctcagtgtgactagcaggggcctgaagtgctgtgctgaaagaggcactgtggtcccacagcccccacccccagtcagggcataaggcagcactgaccagctcaatgtgagtcagctgctgggccagcaccagggggtcgcagcacacgcccaggatgtccttctgggcggctggtggcttggtcttgaggatgggccccttgtctacagccggtggccggagcttctctcgcagttcctggagctggctccgggcagccaaggacagcaacaggctctgtgtcatctgggcaatggccttcttcactgtgccattctcctgtggggtcaagggcaataagggtgccagcatgggctggcagcaaggccaccaccactgtgggtaggatccatctcacctccagggatgtgcctaaccaacgtgagcccacagcccctatctaaaccgcagccttcaggccttcaaggacaaagtggggcacagcatgggctcctctgaggactgctgaggaggggtctcagtgggctgtcctgctgcaggacgaggctaagggcagagacaggctcaagactgagcttctgggtctgaaaagcatggctttttcagaggcggcccactgagctgcttcctgaagcaggagcagcccatagaacagtttaaggcatgggaaaggcttctgccaaagccaggagtctctgccccctagttgggagcagcctggggtccctggctcctcctggagtactcggggtgaacaggagctgctaagcacagggaatgcttccactgtggaggcccagttggcccaggcatctccagttctctctccaccaaaggcaaaggtgaagacatttgaaaaatgggagaccggtttaaagccttacccccacctcctctcactaatccaagacaggcagagccttacaaactctcaataggctcccactccagggacaaggacagcaagggccaggagagggttgagacaatgattgccaggcccgcaaccgggctgcaaggtccctgcttgcagtatcatgggtgaccctggcccactgctggccagctgagctgtcatctgggggaagggaggttgaatggggccagccagcaaccctcctgggggagtaacatggaaggggaccacatacagagttgtccccgaagcccccaccctcccgagggcagaccctggcacacacccaaagaccctggccagagcccagggagcactcacctcatcacactgggtgacacggtgtgtgatggctttcagctcggccatggccttctcatcctggaagtcataggggaaggcctcggtccactccttcaggagctgcacgatcttggctgagaaagacttcagcttggcctggggcagcaggggatacagagtaaggccccacagggcagagtagggtactagatggcaaatggtgcaagcttcccacatccccaagccacaccccaggccctgtgctgggcacagcccccaactgcgtgccacctgcggtttggccaaacctgaaccgccacatgactcctgtttggttccttcttccttccccttaagttgactttctttttcacttaaataaacttatattaaaaaaacccaccccatctctaaggtgacaaaaaactaattccatttgctataattagaagttacccataaaagcaatacagtaaaataacccaagccaagccatccagttagaggagagctcccgtctgccccctgtggttgaaagggcgacagcgctgaaaggggtgtgaccccgaggggaggcgacgcgctcccgcgccctagtccacaggcatgcacgaccccacccagcacagggcctagggcatggggactggccctcttggctgaaacgactccgaccctctcggaagatgcccgcgcggcctctgcccccggggagaggggactgtgcccgatgctcaggcgccgcgcccccatcctccaatcccccagaacgcaccacaggccaagcccctcctgcgccagccaagactccgcgccagcccacaccagccccactcagaccgctggaccccgcccccggcccccgcaccacccagcccgcaactctgcagctttcttcgcccacgccgcacagcctccaaaccagcggattccgcccacgttgccagcctaggccccccaccacccgctcccaccacgcccctaacccggacccaacccacagctccagcccagacctcaccccagcctggtgtggcgtcacgccccaactcagacccgccccacagccccagccaggccacgccccaaccctagccctgaccccgcccccaggccccaccagcccagccaggccatgcctaaccctagcactgaccctgccccgagaccccacagccccagccaggccacgccccaaccctagccatgaccccgccccctggtcccaccctggaccccaccctgcagccccagctaggccacgcccaaccctagccttgaccccgaccctgccccagccaggccacgcctcaaccctagccctgaccccaccccctggccccaccctggaccccatcccacagtcccagccaggccaagccccaactctagccctgaccccatcccccagctctaccgtgaaccccgccccatgcctccagcccctagccttgacctcgcctcctgccccctgcccccgcccgtgccccagccaggccccgcctcaccttttcaggcccggcttccagctgctgcttctgctccacgcagatctgccccacgcgggccagcaggtcatgagggggcataaagacccgggagctcaggagaaaggtgaagatgtacgtcctctgaaggcaggagacggagagagggcggagggagggtgaggcaggcccccgggggctcaccgcgctgcttcacctggcccggctgcctcccaggcccagcaccgccggtcccgaggccatgccttcacctgcccggttcccttcgccttgcaggcccttcctcctcttactgctaccccggccctgcctacctaggaggcacggctcgagccccgcctcccagcagctctcccaggcctcctagcagtcttcctccgctgggattctccccctctctgccccacgccaccatagggctaaccccagcctgggacgttggtagggctccatggtgctcgctgcgccaggatgcaagccagctgctgtttcagatcctcgtgggccgagctggaggtcagcggtggggagggtgggggatgcagggaggttggcacaggagcggggcctgtcgggagcagggctgatccatggggcggggcctcatcagcaggggcggggccccatcagcaggggcggggccccatcagcaggggcggggcctcaggggcaatgctggtgggggcccctgcactctctgaccagctctgggcctagaccctgactgccagagcagggcccctccataccacatccacgtgccttccatcgagatcctcgtgggctgggttcttgggccttttgtctaatgagggtcaatgtctgtgggaacttcactctagctcctgcttgtggacagggtagacttgcaggttgaggagactgcctagggcttcctagagggactctgccccacgtggctgctgcaggctgggctgcccagaagcctctgcctccactcccagcccatataacccggtttttcttgccccagccagaagcaagccaggttgtgcttgctgggagtacaggcctcctggagcaggactcaggggcctgggctgacactgcccaccgcagccctccctggagcatcagggactcctctaacatcctgcaaacttcccacaccctgccccaggctatgcagcatggcgaattgaggggtcagaaccagcacatctctcagggtcccccttctaaggagacaactaagacgtggaggaaaggcccaccatggagctcttggccaagggcagggcacccaaggggagagcctgtgcatctccaaggaggagcatggagaccatgtgtgcatgtttgtgtgcatgtgtgagtgtgttcagctaccggtgcacatggggaagggtggggtggcgggggaggggtaggtgctcggcagaggagccaatgcccaactggagtctcgtgggaagctggtcagatctcagggcacagggaccacactgggtgaccgccaaggtggctcctctggggtaggcctctgagaagggtggcttctccagctgtggcatgaggcctctgccccacagacggccctgccctggactacctcagggccttgggcccctcccctggctctgccctgtgggcactcaccagcctgtctgcactgccatctccagccccagccaaaccctgacagggcttacgggacagacagaaggacagatggaggaggaggaggagtgggcaacagaaaggcaaggccccctcacccaaagcccaggaaggcagtggaggtctggcaggtggtgaagccaggctgactgcagccccgttcagtggaagctagagggcagcatccctcccgcccacctccctgcaagctgtctgactcccaggctgacaagcagggcagggagggagaggggatagcatgatgcgggcaggactggccctcccagagggtagatgctcagctcacaagagggagctggcaggcccagtgccactgctgctaagagacatcaccctccagggggagggaaggcacacttgacaagggaacactttctctgttccaagactgtatcatgccaccttgaggtgaaaagggaggattagggttgttgcctaagaacagtccccgagtcagcctgaacagtgctctgctgacagggcagggcaggccgggccatctcctcttcattctggaccaccagggtttatgtacaaaccagcttcccagctcagccctgggctccaggacctcggctgggcgtgccctcgccaggaccccaagtgctggctttgccctttaaaactcctcttcctccttggaggccctgctcagaactcagggccctgctcggcccttgtgtgtttctgcttcccgtgtccctaggatcatctcctcctacctggggcagcagcagggaagtcacagcaggttcccccaggccacctgctagctggtggtgtatgcagagcagaaggcagagaaggccctagaggtgggcctgggccccccactgccctgcccctcctgcagccctgtccagctctaccactctgtgggggcctccctcccacacccgacatctcctggagcccaggtcaccccattagtctcactccacaaggccccacgtactcacatcggggtaatagtccaccgtgggaacaaggtgctccatcagggcctccagggacccagagatgaggtgtccatcttggaagatgaggtccccggagccgccaccggccccgcctccacgctcccccatgccaggctgcacctgtccgctacagctgggcccaaggatgctggagaagacaacggacgtctggggcatagtttcctgggagaaaagagcaaggacatgaggcatcaaaggcgcctccacagctccacagaccctcctcccaggcagcctgcagcgtgcatgcatgtgtgcaggggtgcgtggcaggggcgcagcggcactggcagagggcacccccattccagggcagggcaggcgggctccttggtggtcccccagccgctgcacatctgatcactgtgtcttcagctccctgtgggccagacctcattccagggccctggacactcaaagccggcagagaagagaaactctgggaaaaatgtccaagaagggacagggagcctgcggtgggcagtcagggctgcctggggtgagagggctgtgaacaactgatggggctggccgcgcagctcccaggataagaaaggaacaccctaggcatgaggtacagtgagtgccaaggtcctgacccagagatgtgtgcagcggggagctgggaggacagtctgaggactcagggccggacacacaggctgcatgtgctgcttcactgaggtgggagcctggggctctgagcacagtggtctgacttacggtggctgccacgtggatggtgggtcttgccacagcccaaggagagcttgctcaggcaggcggtagcaggagtggcgagcagggccactccacatggtgaaggtcttgggccaagtggctgaccagtatgaggcagggctgtgggcagggctagagagagatctggaactggctttggggcctgtgagtctgagtgcccctgagctgcagatgtctgagcagctgggcctcctggaggcctcggtgcccacactgggactgtcctccacagcatggcccgctgtgatggggctcagggtctcaccacaccctgcagctgggagttcttgtgaagcctaggggagtctgaagccctctgggcctgtttccccagtgccccagacagccagccatgcctgggaggagccaagtggggactggacgatgcagcaactgccagcctgagggccagaggtggcctgcctgtggccttgcctgcacacagagccagcctcaacctcctggccctcaagggaaggcagcacaggtgccagcggctgaggtcaggtggagaagcgagaccctcctgccattttggccttagtttccccactgcacagagcaaattgttgccatgattacttcagtgccatgacaggaccgtgggcctctgccctgtaggggccttacaaggagagagcggaccacctgcccacaccccccacgtcaacacacacacacacacacacacacacacacacacacacacacacacacacacagcacgtccctgtccctcccaccagggaaaaaagagcatctggcccagacgtcactggttttcccaccaaacacctaaaggtttccttggaattcttagaaagtctttggcaaggagagcaagaacgcaaccaaaggccccacgatgacgctgggtggaatgtccaggcccccaggctcagtgctgcccccactccaggacagggaggtcatggctcagactcatacaatgctcccttcaaactcaggccagcagcggtgcctcacacaagttagaatgcacattctcaggcctagccccagacctgctggtcagaaactctggggtggactgcttctgtaccccaacgcgctctccactccagcccaggaaccactgatgtgagccaatccttcatttttcagatggtgaaactgaggcccagtgggaaggaactcaactaaggaaaccccaggagttccaagtccagcctaggtgtcaccacctccaggaagcctccctgggtttaacctagactgttgacccacaaagccagaagtggctgtatcattcacctgtgtatcctatcgctggcccagggtggcactcagtgaccatttgtgcaatgaagtcacgaaggcgggctcacaaaccccttgttgcccacagctgctcagcactgtctcaggcatctgaggccaatgcactgtgggacaacctccccaagatcacacagttctgggttcaaaaggcgaccagcaggtggtaaccttggtcagttgggcctcctcaccccaagctcttggggtcatcagagagggcatttgccgagccactggcctctcccactgcaggctgctctggtcaggaggtagtatgtgggggatgcactctgacaccccacaaactcagccccagccgatcccccacagggcaaggccactccatgtccagcctgcagagagacctgcctcagtgctaggaggcctgcctaggagttgaggagccatcctggggacccagcccactggtcagcagccagagaggggctgggaaggccacgccttcgagggtgggggcctggaggaggagcatgcaggggtgtcccaggcaagcagaggttctgcacatgctcagaatccctttggggagtcagcagagcctgagggggaccgtgtggagccgcactgacctgagaggtggggtgctctgggttccttctgtcctgcctacctggagacccacctggggacacggcccagggctaggtctcctgcatccaacaaaccaagaccctgcaggtctgggggatgccccatgagcccctacccccgaaagctcaaacctagcagggcccaccctgcccagccacggagcacttcgaggagggtctccagggctcagtgccaagtggagaggcaggttccctacatggcttttcccgggcaggaatgccggccctgcagcaggcccactccttgttcctgggtgcatctggccagccctccaccttcccagctgtgaaatggtgatgatgacagcacttccactgcggggtcccctgccggccacccccacccagccctgaggtcgcttgttcttgcacctgcttcctccttgccccaacagcaggggcaggcacttcgacaggcagctgcaaacctgtgtatctgaacagctgtgtccaccaccaggcagccccttcccaaggaagaattgcacactgggctcttggctccagtcacagcaatagccatcatgatacaccgatggccagggtgctgaacactgaaaaccgcaaggctacagttgaagaatcccagttactcttcccagtcaccccctatgctcccagagaacccgttattcccttacgcagacgaggggtgagtacctgccccaggtcacagccagagggcaacagtgccaggattcatgccgagcaagcagcaggggtaggcagggagcccaagtccgagcctggctccaccacctgtcttggctatgtcaagatcctcaaacccttggagccttaacttctttgtctgtaaaatgggcacagggagcactacttcagaggtttgcagggaagatcagaggagcccctgtgtaaggtgctgggcaccaggtgcctcctcacccccaggagctgattcccaccagcatgattgctcagcacccctacagaccacacaggaggcactgcttattctagacacactggccctttgtgtttgggcactgtggagagctcaggaagcccccccaccagggctaggcagagatagggctgtggcgggccagcttgctcaaccagcatttgtgggaaccatcacctccaccccaagtccagctggggctggcctggacagagcaggccaccctgaccccagagagccagaccctgcatggatgctctaaggccaggtgtggtccccagagcaggagcagtaccttctcctgagccagaaactggtgggagtgggcccagtgctcccctttcaggtagctcagctgcacactggcgttctagacccttcccctacagcctctcagttccaagtgtggccgctggacctgcagctaaagcatgacctgtcgattgtcaaagagcagatctcaagttccaggccaggcctgctgggtcacatctgctgctgagcaagacaccaggtgaatcatgtgcaggtgaatggaaggcccgggaagcccacctgtgtgagaacctcagcctccaggtaagctgcaccggctaactcagagcaggggcctggtacggaggctcatgcctgtaatcccagcactttgagaggccgaggtggatggatcgcttgaactcaggagttggagacaagcctgggtaacatagagacccctgtctctactaacattcaaaaaaaaattagccaggtgtggtggcacaggcctgtggttccagctacttggggagctgaggcaggaggatcacttgagcccaggaggttgaggctgcagtgagccctgatcacaccactgcactccagcctgggcaatggagccagaccctgcctcaatcaatcaataaacaaaccagggcaggccctcagctgtagtatgtgcacaccagcaccatgtggggatttttcaaagacaccgtgcctgacccctgcctggacaactgatttaactggtctcaggggcaggagaggcactggcatcttccacagacttccaggaagcacggggagcctctctcctgcctcagctgctcctggctgcaccagacccatctcgaggcagcagaccctgtgaagggctcaggaagcaccctcctcccacccaggatgtaggcacagacggggccggggccagccagtgtgccagaccagtctctgtgggaaccctcacctccaccccaggtccagctggggctggcctggaagagcagcagccccttgcagggagtgggggacaggcttgcacccagtagcccctctgactccttggagcagcagccccttgcagggagttggggacaggcttgcacgcagtagcccctctgactccttggagcagcagctccttgcagggagtgggggacaggcttgcacgcagcagcccctctggttccttgcagcccctcctctgttcaggcaggaaggaaagcacctcctaattatagagctaatcaatgcagaagaaacgtgcttatagcaaagcagagaagagtgactcactgtctcctggaggacgcgcctcactcccttctcacctcccacgcagggccggtggacacaagggcagtcccaggggcccagcctgctggtgagaggggtgccctcttccatcttggaagagagcagatttccatacctggctttacttggctctctgggggcaccattcgagaagggggtcctccctgtatctgagcctaagtcttcctggctgggcctccagggtcacacccctgacctgcacagcctcagcagcactgtaggaggcctggagtggaggctgcctgggagaggctgaacctagaggccccttgccacctgcctgccaggatgcgctgcagcaggacagagggcaggcggcagacaaccaggcacagggctctccccaggcctccactactctgcctcattgtggctatcccagccttttcaggcttggcccaaggtgccccacctggcacatatgctgctgtcccccagaggatgaagtgactcgtggggtcctgctgctgtccctccttggtctgccacaggtgataccatcctgagaggccccccacagctgcacccccagtctctcatgcccttgtccacacccccgcacacctgagtcctttcctgcagttgcagatcctgggcctgggactgcatgccagagaacaggctctgtccccacacccacgggaagcctctgggtggccctaagcctgcttcctcggctggacactgggtgtggaatgtcttgtcccacctccctgcagggttgcagtgaggttgaagggagagacggaagctagtgcggttgtgtgcctggagcagaaccaggtatgtggttctgtgccacccacatctaggccttgcctcaatggtgcccagtggcccagtgctgggtgccactgcttctgacctgtggcctctgacctaggcccttagggccatgggcacacaccacaccgccagccctgggagaggttggggctggggcaggttaacaccctgtaggaatcctcaccccagaggcactgttttgagacacagaagtttcacagagcctccccagagatgcctgggatgccagctgttgttggaacacatcccggcatctctccactcgctcccagcctcctgctgcccgggactgtgcttcccaataaagcgagcacagccaacatttccgtgagctctgatctcaggtttaagatgggctctgagaccttgcaccccgccccatggagtgagtagggtagaggaggggctgtcatctggtttctcaaccccctctgactctagaacagccacgtgctgatggcgccaaagtgccaggaggggagaggccaggagcctgcatccacatgtgggccaggcctcccattggtggtcggcctggggcagttcctctgtctgtgtgagccttagtggcactggcacctgaacctcatggtggctgtggggagtgcggggtggcagggagacacatggagtgtggcttccagcccagcacaagtgctcacacgcagggcgtgcttcagtgcaagtgaacactgctcctggggctctgctcagcctgggtgagggactgtgggaacacagccctggatctccaggaccttttccagtgggtacgttctggagctcagcctcaatacacctcaggggagaggcacttttaggggacacagcctaaaactttagcttctgaatattcacagctccccccacaacactcacacacacaggttcacacaggtgcacacatgcacacacaggtgcacagaccccttcgcaccaaggaatacactgtgccaatcacacagcactgagagtggaggtcactatgttaagtggagcaagccaggcacagcaagaccaacgctgcatgttcccactcaggtgggagctgaaaaccttgctctcatggaggtagacagtagaataatggctaccagagggcaggagcgggaaacaaagatagcttgggcaaccggtacagactcacatttagatagaagaaataacttctaatgttccataacagactcaggtggctatagtttgcagcaatgtattgtatacttcaaaagagatagaagaaatgtttccgacacatagaaattacaaatgctcaagatgatggataccccaaataccctgccttgatcagcacataacccatgcatgtaaaaaatacatgtaccccataaatatgtaaaatactacatatgaataaaagaaaagaatagcttgaggagaggaaaaaagcatagagagcaagaatggaagtggctagactgagggtccagggtgagaagaggggagggggcagccaggatctgagaaactttccagccttttaagaaagtaagaggagggaccctatgtagccccagtgctatgagagatcctgggagagagaggaaaagggaagtttttgtgaaagagtacgaatgacattcctttttgcagcctcttcaaggacgttggagagttttttattgttttttgttttgagacagagtcttgctctgtggcccaggctggagtgcagtggcacgatcttggctcactgcaacctctgcctcacaggttcaagcgattctcctgcctcaggctcccgagtagctgggattgcaggtgtacaccaccatgcccagctaatgtttgtattttttagtagagacggagtttcatgatgttggccaggctggtctcgaactcctggccagcctcaagtgatctgcccgcctcaacctcccaaagtgctgggattacagggtttagccactgcacccacctgctacccagctatctaatgtgacccatgcccgtcccccaggcagcacacagagagaggccatctgcctctggcctcatgtgtgcaaaagctggatgcgctcctcgggaggggcagccacacagtgtgtacacctttcctgagctggtgcacagtccttccctccattcaaactgcagccatggactctgagaccttgcaccctgccctatcacccatgagctcctgagagctgcagctacgatggaggcccagcagctctgagcccaagcctgtggcctcactgcagccagagcctgctgtgcgtgtcgtcttcccgtgcacccactcatgtgtccaggcctgggcagcagctgggtcactttccactcccgaatgttctttctgtgtcctgcactgaggatgcccagtgatgaggagacccaacagagccacaggaggcttgacaccaccgtggcctcataaaagatccccagggaagggggacgcaggggtcagtgagcattcacccaccccgccccccttcgtaggtgtgtgcacagagcacaactgtccagctccccaaaaggggctatgggaggagcatcagaaggtggccctatggggtaactggccatcctccaacaccaccagccccaccacagcagagagtaggaacaacaggccaggaggggacagagtctcctgcacagctggtcaggaacagggtcaggcctccgttcaactccaaagggaagagcagtataaggcaggctcctagcacactgtcggaattctaggaccccttctggatcctggagtctgcagttctggaaacttccaaagcagggattaaccttcacttgactaaccttgctttgctttaagtgtgcatcgttaggagttagagtgagctgtgtgctggccattccatgactcatctcaatgcaattctccctcacccagggagacagcccggagaggcccgtttctcagatggggacactgaggctcagctcacaggacccaagaggccgtaatgtgcaggactgcccaggtctgccctgctgttcctcggacctcagcattgcccctgagagcacctggcaggggcatggccccctgagcatcaagtgcaggctgaagccctggcctggacatgtggacaagcacacattcccacgacctgcagatgattcgggggaccgatgagctcccagaagctcatctgtggacttcaaattaagaaacccagcttcctggaaaactgggacaaaaacagccctcagggcccatcatgcatgagtcccagggatctgccaggaggtggaggaggggttcgagccagccccctgcctctgccagccttggcagggggcttctttctgaggcagcacgtgggcttctattttttaacctactcaacaaaaacggagactatttttagctcagcaagctgcagggcatcacaattagcaactgaaaattacacatctcgcctgtctcccctctcttggctggcagggagagcgtgctcctggagggagctgggggcagccctgtgccatgatcctggtgggcctcaggaggggagagacctgcgcacctacctgtgctgggctggatgcatgccacggacccgacagaatgggctcttcgcccttcaagggataaccggccagttctctgaaattaccggcactggggtggggaaggaggtgggtgttcccggagccctattctttgcccattcattcattcacaagtggtaatgatccctgcctagatactggagatacaccaggggaaaaaaacagggttctctggccccagagagcaccccacagagcctgtgtggtgccacgcacaacggccacagatggcgacatgatattctgggttaggagagaatcagtgctccgacagaggagatggaaggtcaggaatgtgagtgggaaagcggtaacctctgcctgggcggtgaggttggcctccctgtggaggtgaggcctcagccgactggaaggagcttctgggaaaggacgagcagagtgagtggacagaagcgctggcgccaaagcctgggagcttttggcccattagatctctggcaaaccctccctggggcacctcctggctgcctcacttactccaaaacatgcactgactgatgatgtgtgtgtcggccttgctaaacctggacctgtgatgtgccaggatcagggtccccagcagtgccaggctgccccccaacctggcctggtccccaccctgccaggagcgggggcgctggagccaccagcaccccgggcacatcccaccaccaccgccattgccatcggtactcagggtctatgcctacagtgggtgggccgcctgccccactctgtgagggtctgggctcctcccaccaggacatcgggaatgaggctcccctccccaggaggctcccccaggatgcagcaggtgattcctggtttccttgggggaccatcttgtgggggtcctcaccttaccctgcggggagggctcagcagggagtcaggcgcaatttgtaagtgaagtgcttgtttgagtgtatgggaggcaggcaccatgattacaagattccccatgcaaatgcacatcttttgctaaaccttcagtgggccctttgccttagtgaggattttgcccccctcctggatagtagacagtgctaggtagcccgcccaggggctgccccacccagagaaggccgttgggatgtggcagtgggccacgtcacagggaagaaactgcccgccttggggagggtagagggctgagtgtgcccacttggcttgaagactcagccaccctcagggaggaaagaaggaggggcactgctcctgatgggataagaacctgcatggggtggcagaggagggggaaggaggttaggggcctcctcccttccacccagcatgcagcaaggacagacttcaccccatctccctcctgagctccatcaggaccggtcagatagtggaggcagctgcgcctcctttgccgctcacccttcccatcttacacacccttccccatcttctgaccctgccagtccagagctgcattctcagaccagtaaaaagagccctccgggatcccacctgcactgagaggcatcgtggagggggagaaatgaggtaggggccacccccacctactggatgtcactcactggcaggggagcacaagcgaggggagccgatggcctgcagaagacaatggggccactgcaccctcagctggtggagcgtgctgggacccgaccctgagggcaccaccccagcatggggctgggggacctgtatggagctgagaggaggagtgcctgccccaggcagcccccagtccttccatccccctttggctcccatttctctaacacccctgtcctggtgacatgtgtccctcgctcatgctccctcttcccacgccagggctacagtgctctctccaagctggtgctgcagtcccaggcgctggacgacccgcctcagcgcctccatccccactgcacctaggccctcccagctctgtggaagaaggctgggtgaccagccactgcccagcccctctaccacacctaggtcctcccagctctgtggaagaaggccgggtgaccggccattgcccaacccctctggacgtcatctatccacaatgtgcaggcaagtgacacctgcctgggagagtctggggcttagtctccaccatttctgagattctagtgcctgctagagggactagagccaggactctgactctgcccaggttggccccaggcctgccctcaacagcaggtgcgccacatcagagccccttcccacaaccgggctgcatccacctcctactccctgacccagggcaggaagggttctcccccaaccacccagccaacactcagatgtcctccccatccccaaatcccagctctcagactgtcctgactgagctgaaacgtgtctcccttaactccagggagcccttgtcccatctgctgaggccatgcacagcagatgggcagggggcagctgcaggcccaggctggatctaggcatgggctgggcgtccaatgggaagggagtgggccccaccccagctgggagccggcaccctcctctgtgagatgccacctccagcacctgcttcccaggcgaccgtgagcactaagtgaagccacaaagctcaggacaggctcaatgcctggtgggttctgatggcatcggcactgcagagcactagcggtcctataggtttcccagctgcctccctagacacacagctcttgggagctggtgctgccccctccctcatcccacttctgggtccttctcacctcccatgcaagggacagccagtgcacctgctgcagacagcaacaagtgaggagaagctgcctcctgcttctaggcaggtggacccgttgacctggttgcactgtcctgtcccaggcatgggggactcagagctggctctggtctagggatggggggcgttgggggtgacactcccctgcaggtcaggctctccagtcctcaccctcctctctctcaacccttgttccctctgcagcagcacagtccttgggagcacatgctggccccattcctgcagcagggcagggaactccctgcagcccctgcctctccatcctccaggccaggcaggcatcagagggcaggggccacgctgtttcacataagccaaacttcaagtactgcgaagaagggccggatttacctttgtgaaccttccgggctggccagggcagtctcagggcctggccaagggcctcaggccggactccaacaaggaggcggctgccatgggaaccagcacgacagcgcctcacagggcgcccgctccagaggcctggccacaggcgcgacgcggataattaaagctttgttacagacacatgattcattttttccttctgaattcccttctattacccaatacaatttgaattgactgaaggaatctggtcgtctcctcttcacgctcctcagattctgcccagtctgggtttctgcctctcccttttccctttctgtccagtcagcttcttctgggcctgctcagggcatagaacatcattgtccaccaagaaccattccattcttgagactcaagaggcccaaggatgcagcaggtgggacttcagagaatccctgccctttcccggcaggcgctggcagcctggcctcccactccagccgcctggggagccctgctcccccctccccttggcctcgctccctcttcggccaacgccatcagattctgcaggggtaacgagagcctcctgtagatgggtgggcagccctgtgcctcccagggacagagctgggcacaggcttggatggggtcatgtgcaaactcacgcaaccttggtagccagttctgtcctttccagggagacccctagggtgccacggaggagggggctgggaagcagtgtgcagattccaccccaagtgaaatcacccctctggggtccctgtcctagatgggttgtccactgatgatgacaggacagagcagggtgtcctgctgctcatcagttctgggcagtggccagggcgcctgctggctccagtaggaaggcaccagcaatctgtcctgcccaggcccacccgggcacactgcccacatccagccagccctggagtcagccccgaagcagcagcccatgaccaagagagagggacagtgagcgggcagggtcagggctgagggcctccagaggcaggaagggatggccagccgcgtaggccacacacagacctgtcccgggtgagctgcacctccgccctctacagccacctagggtgctgggatatggaataaaagacatatggttcttttacttttaaatgataactaattacgctgagcaaagatttttcctttgtgttccaaaacaaataaaaatccatttccctcacttgaattgtcctcctggcagatggctgtgggagcagggagctctctctgggccagtcatgggggtaggggaagggggcacccagccccctgctgggtcacagagccatgggcatgctcagtctggcagcctctgggaaacagcacccagacacacgtcctgactgccacccccatgccgtggacacaggcagctcttctgtcacatgctgtgcgtctgtcccctggccctgggggctggtaaccggtggttagacactgaccagccccaagagtaccagtgcacaggaatgtgtaataatgtgttgtggtccttagggtctcaaaataaacggccaggcacaatggctcacacctgtaatcctggcactttaggaagccgaggtggaggatcgcttgagcccaggagttcaagaccagcctgggcaacatagggagatccctgtctctacagaaaaattagccaggggcagtggcatacacctgtaatcccagctactcaggaggctgaggtagggggattgcttgagcccaggaggtaaaggatgcagtgtgccaagatcataccactgcatccctgggtgacagagcctgggcaacagagcaagaccctatctcaccgggtgtggtggctcactcctgtaatctcaacacgatgggaggccaaggcaggcagatcacttgaggtcaggagttcaagaccagcccgaccaacatggtgaaaccccatctctattaaaagtacaaaaaattagccaggcacggtggtgcacacctgtaatctcagctactccagaggctgaggcatgagaattgcttgaacctgggaggtggacgttgcagtgagctgagatcacgccactgcactccagcctgtgtgacagaacaagactctgtcttaaaaaaaaaaaaggggggggagtacttatgacaagtaactcagcttagagtgaagttgctgagccctcagagtgattagcataggtgtggtggactgcaatgatcagatgatatctgctgtggccaggcatccctgagacccaacaagaaagtgatgtcaaaaggcacctgaagatgatggccagggacactcctgcggagggccataaatacaaagaagctgctcatgaccaagacacctgcagaagcactgccctcgagaactccgaagcctcttttccattggaggccaccagacgccctgctgggagaagaggagtgatcccatccctccacccgggggtctgcggtccctctgctctgaaggaacttggaccctgggcaatcagcagctggtctccccatcccccgacactgtggttcgctcccgcctctcttatgactgcctgggtgtgtggaatatatttgcatgattgttggggtgtgaaaacgtcccaataaaccatgaatttgtaagcatttaattggctgctgagtcatcctgaaacctccccacatcagttagtgccaccaggctgattcgaacctaagccagacacagccgtctccatgcctccccagggtggccctcctgctgctccccccttctccagatgaaggaacagaggcccaaagggcctcagtcaccagcgccagtctgggaaactggtggagctgggattggaaccctgtctgatgtgctacccagggcaaccagcacagggctccggagaaggagaatggtgtgaggtgacagcagggggagccagccaggcctgtgggatggacagggcctgacccaggaggagctgcccctgctgcatttgcaggttaggctgcaagcgcagggcagcgaggtggggtgggggaaatcaggccagggtccaaggggcccgtgctgcattctagcccctgcaaaactgcccacaagcctcaccaccaatgagtggcgtaggcagagggcctcccacctgctgggccctgtgacaccatctgggggcctctgaggccctgctctccacttcccagatgagatacaggtgtggggctgaggacagggcacagctggaagccgcccaggcctcctgcctgcaagttggcccttcctgtccgtgtggcccgggcacatacagtcatgcgtccattcgcgacggggatacctcctgagaaatgcatcttaggcgatttcgtcgttgtgcaaaccccagagtgacttacacagaccaggatggcacagcccactacacacccaggctccgtggtacagcctattgctcccgggatcccaacctgcacagtgtgtgactgcactgaatatactggaggcaactgtaacacaacggtaaggatttctacagctaaacatagaaaaagcacagtgacaatatcatattatgaatctcaggggaccactatgtggtgcatgacgctgtcttttttcccagcacaccctcctaacactctcagaatctccaaagtggtaagtgtcttctgtgtgctgatggacttctggacagcctggctgggggctggttgtcaggggaaccaaccatgtgatgaaagggtggggactttcactcccacccccagctctagggacaagagagaggctgaaggttgggtccatcaccaatggccaatgattcagtcagtcacacccacataatgaagcctccacaaaatcccaaaaggagcggcttcagagcttctgcgtaggcaagcaggtggagggccctggagtgcagtgcctgggaggacagggaagctccacgccccttctcacatgccttgccctgagcatcccttcctcttactgttcatctgtgaccactgtaaaaacctgcatagtaagtgggtaaatggaagcaagtgcttccctgaattatgtgagctgctctagcaaattaattgaatctgagaaaggagtcccaggagtggtgatttgctgggtgggtcagaagcacaggccacaacctgagacttgcaaatggcatctgaagtcgagggagggggacagccttgtgggaccaagctctcaacctgtgagatctgacttcgcctccaatattgtccaaattgaattacagggcacccagctgctgtcttaatgttagagaatctggtattagaatgttgtgctaaatggctgagagtggagagtaagaaaaacactttattggttttttttttataaccctattagaggtaaactcccaagaacacaaagctatgcccaggaaacacagtgagcacctcttcatgctagattcacaaccagaaattgcccagcaagtggtagatgcccaagggatgaaaatattgcagtgcatgctctctggacaggggaccaagatatgtgaaaaactgtgtctagaaacagaaaggcacattctactgtccagagtctctgccacatggtcgtatgttataccaccaatgaaacccagtaaagtccccaaatagaagtgtgcaggtgagagaatgacataagcacaatgtactatagttggatattaatatataactgataaacaaaatacccacttcataaaaaaaatccctaaatcacacctgtgttaaagattcaaattccaattacagatgtcagaaaaataacctttataggaaaactctgtatcgaatttgatatggccaaagctgtactcacagaaaagttcatagacttcaataatgtattgaagtaaacactaagcacttgattcaaaaagcttaaaaaagagcttctcaacaaaacagtgaaacaaactggaagaagaaactactaaaaagcaaattagatgacttaatcaaagaatagagtagaactccttataaacttcaagagctgattctttgaaaacacagatttcaaggataaccctcttgcaattctaatcaacaaaaggaaagaagaaagggagggagggccaggcaccctggatcatgcctgtaatcccagcactttggggggctctagtgagaacctgtctctatttctttaaaaaaattataaaaatttattttaaaaaagaaagggagggagagaagaaggaagaaaggaaggacatgaaaaatacattgggcatgaaaaaagggaatctaactccagatatgtagaagaaagtttaaaacaaacaactacctaaatctgtggtaaatgatctgcaagaacttttaatggttacttatattatctagaaaatataagtaaccaaaaatagagtaaaactgtttagaacccaaaaagaccaataaccatagtacaaattaagttgagagccaactaagcctctggaaaaaataaaagaaagccctggctgaaatagtttctaaaatgaattatttcaagcctttgaggataagataattttatatgatatataaactatttcaactacacaattcatattgaaaagccttcctattcattttataaagctaaaatagcatgatttataaatgtgacaaatatgtctcctagtagaaaagtatgcataaattcttacctctgaaaatagtgaaaaataccctcagcaacatagcaacacatcagtaaaatgaactcagcagcatttttaagcacaatagagcctgacccagtgggctttattccaggaacaagaggatgatttagctcagaagagttaataagtcaacacattaataggtccaaggaggaaaggcatttgatgattttgctagatataggaaagcctttgatgaaactgaatatccattcctggtgtgcactcttggcaattaatgtaggattccagcacactgtccttgatgacgaatacctattggaaatatgggccagtttcagacttagtaaaacatgaaaagcctcctcattaaaatgaagatcaagccaaagacaactgctattatttaatgttactttgcaccttttagaaaacataataagataagaaaactaaagatacattagaaataaagaagttggctgttccttatgtgtaagtaatataattaatttcttggattttccaggaagccaaactaaaaatctgttcaaactagtaaggtatcaataatcaattacctaacataaacttttaaaaaatcaatagcttacttatctacctcccctgggcatatgtgtctgcccataagtctgtgtggagctgttacagagatgctcacaccagtggcagtaggggaggtgtgtctgtgtgtctctgtatgtgtctgtgtgtctctgcatatgtctgtgtgtctgtgtttctctgtgttagtgtgtctctgtttctgcgtgtgtgtgcctgcatgtgtctatgtgtgtctgtgtctctgtatgtgtctgtgtgtgtgtctttgtgtctctgtgtctgtgtgtgtctctgtgtctgtgtgtgtgcatgtgcctgcatgtgtctgtgtgtgtgtgcatgtctgtgtgtgggggtctgtggggggggggtctctgtgtctgtgtgtttctgtgtgtctgtgtctttgtgtgtgtctgtgtgtctgtgtctctgtgtctgtgtctctgcatgtgtctgtgtgtctctctacgtctgtgtctctgcatgtgtctgtgtctgtgtgtgtgcctgcatgtgtctctgtgtctgtgtctctgtatgtgtctgtgtttgtgtgtctctgtgtctgtgtgcctgcgtgtctctgtgtctgtgtctctgcatgtctctgtgtgtctgtgtgtctctgtgtctgtgtgcacctatgtgtgtctctgtgtgtgggtgtctgtgtatgggtgtgtgtgtgtgtgtgtgtgtgtgtccacggatctctcagctctctaagctccactaccatcccccaggaacacgatgtccacagtgggcctgctctgccaaccagctcagctaccctgaagccacttttcctggtcacccacccaaaacaccacaccactgccccctcaggctgggcactctaggaacatgccagtccctgttttaaggacatctgttgtatgtggccccagggaggtccccagagaagtcatactcaggttggggccagagttgaaggctgagcctcctcacccacggggagggggagagagaggagggcggcgctctgacgcatacttaccggcccaaggctgggcaggggtggctggcggcagtcacagtgacatttgggaaatgccaggggctgggtcccagcccggaaggcgggtgtgggcggtgacaggggtgggggctgggttattccccgaggctgagaccacaagacaccagctttgccaacaaaactccacttggccagtggtgccaggggccgcagggccagggcccagccagcagcaggggccagaagaagaaacagagggccaggttcagtggctaatgcctgtaatcccagcactttgggaagccaaagcgggcagatcatctgaggtcaggagttcgaaaccagcctgaccaacatagagaaaccccgtctctactaaaaatacaaaattagccaggcatggtggcacatgcctgtaatcccagctactcaggaggctgaggcaggagaattgcttgaaccccagaggtggaggttgcagtgagatcatgccattgcactccagtctgggcaacaggagcaaaactctgtctcaaaaaaagaaaagaaaagaaaaaaagaaacagagaagctgaggggatcttggctgccatcctcctccgagatccacgccatccatgggctcccacctgactgtccccgggttccctcaggagcccccacgcctcgtgtcccatctgcctctgaactcccattgtcctggaacccacagggacccaggcagcccagaacccacacagtggagccctcatgacccaggaaccagctctgacccctgacctcctggctgacctcaggcaagacacagcccctctggacctcaatttccccagatgtaaaacaagaagtagagagcctgtacaggccacttcccgccctcatctttgttccttcctttcttccttcctccttccttccagaacttgttcagtcaagtcagcatcccttgaggcctttgtggcctatgccacacactcagaacggaacagcccatggaccttagtgtctgtgggaagacagacacaactccatggcatggcatgatctcttcaggattgggggtctgtgccgggtgtcgtggaggcacggaggtggggaactaactctgtagggagtagtcagggagggcttcatgaaggaggtgattctgagatcagcttccaaggataaccaggggttttccagtgggttaagggggaaaagggaggttgacatgacagtttggtctccttcctctggtcactcaccagcagttccctggagggcgaggtccaagagcccaaaggtgtgggagatgcaggcagcttcccctgcactaagtcaatcctcatgcatcccaccaatgccagtgtgagactctctcccccaggcagcccttcctgactgcctgcccccccgacagatggcactgctgcagcccatgtgtctgtgagtatgtgaccctgggttgtgctgtccccagtgccccctgcatcctggccaggcctggacccccaatgcacagaggtggtgggctaacatgagaggccatggctctgctctccttcccctggcctgtgccccgctgagggctagagtcctcatcccacctctcctggggaagctgaaagaaggtggctcaagctagcaggcccagcaagatgggctttgggcctgggaaggctggggcccagggctgtactgtcctgagccagcaggtgcaggtgtgggtagggtggccaggaggcagggcagcaaggagcctgcagggtggagcaagccaggctctgcatgagcacatgcagcctagacctctccctggactctagactgcccacaccactgccaggcaacacctctggggtgggaagtgttgaactgtccctgctcccacctgctgtgcctgccatcttgcccacctctaagggcaacaccctccttcctgcgccagcctgaccttccccatctcaatgaaaacagcctacccaccagcacggcctccaggtgttgccttcagaatacccccagaatcagtccttccctcctcctccttctctgccatctcccaaggctgggattctcatctgtccccggaccactggggtggcactctgctagcttcacccctcccagcagcagccagcaatgccatggcagccccacggggagcacatcctgctccaccacctcccactgcagccccgtcacccccactggctcccccagccacgccacctcgctggcctcactgtcccacctcctcttgggctctgctcctgatgccccagtctccaatctggccccaacatgcaggcagcttccacttcaaagctctgccctggccttttcctggtatgccccccgcatagctccctccctcccctccttcagcaggtcctgtgcacacgtctcctctggccaccatacctaaggcacagacagccccctccttcactggtggtcagcacgctgggcaccaagtgtgtcagacccctggttgctgggggagcaggactgtcattggaggtccgaatgaaacggggtggggccgtggggtccacctgtctcacagcagtgactggagtactgggctggggcatttaaatgccagtgcagggccctccccactcccctactatgtgaccccgtcagcctgggtccctgaatgagggtggcctggaccagggctgacaccagtgagtggaaactgcaccatgttgtgagctgagggacttgggggctgctctatcgctgcagaatgacctgaactaccctcaccgatgaactcctcacaggccctgctagctctcctacattgcttcttctctagccctcagcaccaggtagcactccacccattttacctacacattgtgcttgttcctctgctgtgtgggcaccgtgaggacaacactctccgtgctgtggtgtttggttccctgctgaaccgcagtgcctgcacacagcaggggcccgataaatgcatgctgagtaagtgaaagaaggaagggacagatgagtcctgcatctttcacgtggccagggctggccggggctcagctccacgctgtgggcactcagaacccagggggctgccgcacccgaatcacaccgccttacgcctctggggatgggtctccataaacagcgtgggaaatgccagtgctccatgctcaggtcctctccaggaccagttctccgcctgcaccctacagcgccctcgccctggagcgcacactcctcgaagccccacggtgggctccactctccctaaacgcacaggcgcgcgtggggctcacaaggcacaggcacggctgcgctccctcccatgtgccgtgaataagcgcgcccgcgcttccgcagccctcccccgcctgcacctcacacagaccacacaccgcggaccacccctcgcccggcacatcctcctcagagcaacaggtggttctgcgcccctcaagtcgtccgggctcctacacgcccgtccccaccccttccaggctcgcaggagccactgtgctctcggcgtccgcgggccgcgccgcgaagggcagggcaggagcagaggcaggctgggcgccgcccaccgggcagtaggtgctccagcggggacgcacagagggcggcgcgcgggtcctcagggcgggcaccctcccgcacgggtcgggatgcaggggaccgtcgcacccctcccgagcccgacagcgcaagaaccctgccccgcggccttgcgcctgggcccgccgcagccctacctggggctccaggaacattctggccgccggctccccgcgccgtcctgcccggtccggcgtccagcgagcggcggctcctctgcccgcgagccaagcaagcacccactcctgcgccggcccctgccgctggacgcctccgctggaggggtgggaccccggaagcagggaaccgaggggctgggctggggaccgcggggtccgggcggggcagaggggccgcgaggccggccaggaacgcggggcggggccgaggctaggagcatggcgcggaggtggggcagggacccggggcggcctggagcgctgtcaggaggagctgcctgggccgggcgcgcgcctggcgctaggtgtgggggcgccgtaggtgccggggtgtgaggctggacggggcgtccgggatcggccgtgccgggggtcggtgctggcgcgcggggccggcgagggggcgcagcgtgggtcggggctcggcgcgggaaggggatgcctcttacccggccccggcctcacctgatcgtagacgtccactacggaactacagcaggtgttctgccagcattcgacttgaatgccttccctgacagggcgctcactccacacagctctggcctgagacaggcgtcgcacagaactccctgtccttccatttcattggaactcgggggacacggcagctgcttttgtgggagggctgatccgagccgcagcgaggggtgggctgggcacatggcacagtgaggctcctcccgcccccagagccccagcctcagaaggaatctgccaggtgatggggctacccctctgcgcattcctgtggtggaccccactccctcagatgatgcggacgggaaagatgcgcggagccgaagagcgccctctctgggggtctggattggagcacccagcacctgagctgggtgagagaccccttgggctctgggggagtccgagttggccggcggggcggccgctagggaggagcagggtatgctcagcttgaacctcacagagaggctctgacaactctggagagctctcaagccacgggctgatggacaatcgtgaccctgacaacatctggccgccccaggatgcccataccctcaccccacctccacccccacggctcttgcccaggccttgccagaggccctctgcctcccagcttgtttgcctgctcacttactagcagcaagagtacctactaggctggctcgatgggcagttgtctctgtcttgggaaagtaggggctgtgctgggttcattcactggcctccctcaagccagctcaagggcctggagacaggagtccttctcctggagtgctgccctctcaccagctcttctctaccagtgagtgttggcctggcctggaaccgcttcccactgctcagagcatgcactatacattactgcgtggtatgcagcgcctgtgggtgggcagtgcggggagtacgaggcaaccaggcagaaatggcacagtggccctccagctttcacaatgtcctcccccacttttgcttctgcatcttgtttcaggccagccagaagatgcgaagctcatggtgaccttggcaggcagacaggtggcatcaggatggtctgggcctgcagggccaccctgtcccttcaggtggcttcatggagagcaccaagaaggtgaaacctggtgtcttgcccctggggaagccttcgaggcacctgcccctgccttcctcagccctgtaccgtagccctgcagaacatctgggccctggggtggccccagtgttgtctcaggaagtccatgtgagcagttggccctgctgcctcctgaccccagagcaagcatcccctctgcctccctgaatgtgacactctagaggaggtggtggatgggtgggcagccccacaagccttcttatgcagtcacagggtcacttcctatcacgctcatcccagattgcaccagtgtcacccaaggaccttgataaggcagacgcttccccgggaggaatggggcccttgcccccatctctggctgacacagatggtgctgtctcctttacccaccagtgtgatctcagcattcatgtgtgacctgacccacatccttcctggtgcctgaggatgcgaggaggctgctatgctggggctgagccctgccaggcgtcctgcttgcatccctgcagctggggctgaggctgtcctgcagggagggctggtgggccctgaggcagaatcccactgccacttcagaaagtagagaagaagccaggtgtggtggggccagtggccatctgccgggacttcagggagaccagacacacaggaagaggcactttctccagacacctcctttaggggcagggcacaaggcctggaacaaggctgcctctgaccagagcaacagagcctgctctgaggatggcagagcctagagcaggcaagctgtcaagattctgggttgagggtcacaggacaggaggctggactcccgctgatatgatttgggtttgtgtccccacccaaatctcatgttcaattgtaatccccagtgttggaggttggaggcgattggatcatgggggcggagttctcatgaatgggttagcaccatcccctcggtgctattctcctgttagtgagtgagtgagttctggagggatctgactgtttgaaagtgtggggcacctcccccttctctctcttgctcctgccatgtgagacacctgctccaactctgccttccactatgagtgaaagctccctgaggccttcccagaagcaaatgctgccatgattcctgtaaagtttgcagagccatgatctaattaaacctcttttctttataaattacccagtctccggcttttttttttttttttttggagatggagtctccctctatcacccaggctggagtgcagtgacatgatctcagctcactgcaacctccaccttctgggtttaagcgattctcttgcctcagcctctcaagtagctgggattacaggtgcacgccaccatgcccagctaatttttgtatttttagtagagacagggtttcaccgtgttggccaggctgatctcaaacttcctgacccaagtgatctgcccacttcagcttcccaaagtgctgggattacaggcatgagccaccgtgcccggccaaggcccttctttatagcagtgtgagaacagactactacactcgcaaaggctccctctcagagtccacccttgctgtctccacacagcagccgggggggatctcttagaacctgagtcagaagctccgtgactcccacctcaatctcgatgaaggcagagtcctaacgaatagccccatcagggacctcaatgctccctgctcagcctcgacaggccctgcccaccctccccctgcgtgcaatgtgctctgcagtgtctgtggccccccaccccgacaggccaccttctcactaacacagctgcaatgccatcctctgccccagcattgtcctgccatggaatggttttccttaaggttactgggtccagcagagcctttccaccttctggttcattcgtctgctctcctgagaatgtgagctccatgagggcaggatctttgttttgttgactgctacatcccaatgactgtaacatgtctatgcacagaggcactcagaacctatgtgtgtgcacgtgtgtgtgtgcgtgtgtgtgtgtgtgtagacagatacagagacacaagtgtgaataaggatatggttgtatatatccagcacaggactcatatccaaaatatataaagaactcatgtaaataaaaaagtcagaagactcaattttttacaaatgggcaaaagacttgaagacatatttcactgaaagaaggctatccaaggggtgataggcctaagagagcacccagctccatgactcatctgggaaaggcactaaactgcggtgtggcaccctgcacacccagcagcaaggctaccatcaaaaggcagaaaatgccacgtgctgacgagatagcacaacccaaattctcagctgctggcggcgcggcagggtcagctggtgcagccaggcgggaaaacagcccgatcatgcctatgaacaccgaccacaccaggcccagaaattccatcctggatggaggctgtgcagaaacactagagactcacaccaaaggacacacgcaggagtgtctgcagcagccctactcacaagggcttcgaactgaaaatgaaccaagcatcccccacaggggactgggtttccaccgagctgtggcatgtgtcactcaatggaacgctccaggccgaggataacccacccagacaaccacaggcaagggcagggagtcaaggacaccaggcacaaagagcatctaaggttggccccacgtggagccagctcagggccggggagggcaccctcacccccagaggtctggggtgctgccctggggaaggggctggaaggggctggatctgggtgtccctgcggagtcaccccatgaaaaatcaccaagtgtacactgtggctctggctcaggcatgtttctgtgtgtgttacacttcaatcacatgaagaaaactgaaggagagaaaaataagagagaacatctgggccaggacaggtagaagctgtcggcacctcagggcctatctaggtctgctgtggccacgcctgagggaagaagggatgtggaggaagggacctgagcctccctccgctcatccccccaagaacaaaggcagagttggggcaaaccctgctccctcttctaaaaggcacagcctacagggtcaagcaatggcaagtgagaggcatccactggttttggaggatggaaggtggcctgaggcaggtgacagaccttgcagaacagagaagcaggagcccagtgccccacagggggctgatgaggaccacgccggtgctacagaggccctgatgaggctcagcccacaaggccttgggttccaggaggagggtcaagggacagaaaggccctggccccccaccctgccctgctgatgccacctcattactgggccacaccacacagtccaagagtttcgggtccaaaccctgaaggtgatggcgcatacctctctatcctctccagggcatgaagtggggcccgagatgccaattcacaagggtgctggcaaaacacgaagcaaaatgaaccaagccctcagtgagctccagaggctcctcagacagcccctgcctcctcaggggtccgagggctcacgctgtctgccagactcaagcctcctgcacacacagccacggtctgcagagaggcccctccaggctcctccaaggctggtcagtacccctgggcagaggccactgatggccctaatcaaaaccacacctaaacacacccacaggctccagggaaggttgtctggcagccaaccctgtcccttgggtcagtggggaacccctaagccttccagaatttccctcaggccataccattagtgctcccttttggagaataatattccatgcactgaatcactcatggctttaggcataaagcgtgaaggagggggtgaatgggagtcagctgagctttctgatgcgcaaggcaacatccttccaggcaccagcatacctgggcaggagcccaccggccacagcgtcaggcacacctctccccagtcgtctgagtcagagcctccacatctttgagaagctcatcaagataccatggtgtatttagcccttccacatcctattctgcctcctggggtccatgagtctttcctgaggctcttcctggggtcctgtgtccatgcgccttggccacccctcctcagccacactcagagaatccagggtttcaacaatgcagcagtgtggggaaggcaggaatgccaggctgggaggcttcctccagatggggctctcaaacctgaccacactgcccaggagcttgctaaaaaggcagtgccaaggcgccatcctcagagatccttcctgcccccattggtgtgtgggactcagtgctcagggaggcggcaccagttaaaactcggcttgggatgcagggcctctggtccaggggaagagagcccaccacactgagtgccagcctgccacatgcacaggggacagtggagaacgcatccagggatcggggggacacaaggcatgggatggggacacagcatcatgcccagcacaatgggacccaacaagggaggaggctgcagccacacaggcaggacgggttgagggccaagacagggcccgggaagtcacttccccgagatgaagcagatgatgaccaacagggacccctcccatcacaaggctctggatacccaccccatcacctgagcagagacctgcacaaagtgagacacagataatacccctgacaccccaatgagaaagagagaagagggacagcacatggaaatagggcagacccagccagaagcaaactacttcatggtgacaaaaagcttgcaagttaaagccttgagtcatcacttggcacctgtgaaatctgcaaaaataatgttaaaggtaatatagagtgtgagcttaagcgtcagggaaaagccagggtcactggcaggaaaaggagagaaatggacagcaggtatccccaagcacctccctggagcaaagacatggcagcaggcatcgtctagggcaccgcgcatccatgtgtgtttgtgtgaccttgtgtgcgcatgtatacatgtgcttgagtgtacatgtgtgcctgagcaggtgtgcgtatgcacatgtgtgctttctgcatgtgtgcataggcatgggtgtgtgtacatagttgcatgcatgcattacgagtatgcaggcctatgcatgtgtgcatgtctgcacctgcgcctataaaacagacaagcatccacataccaaaagtctaatcagggtgccttcctccactggccagcatacaccttctctccgtctctcgcgccctccctcctcctcttctctccatttagccttatcaagtgcttcccaagttctctccaattactatgaatggcttcatcacagcataacacagtacgtgctcatcttctaaaaccaggacatgaggcatccctgctcccactaagactgtgcaaagttaaggctggagcagcagtggcccactcagggctcgcccctccctcggagcccttcacaggctcctggagaagagagactcagaggagaccctgcctgagagctcacacctgagatcacctggtgtgtaggggacaagggggggatgcttaggaccataggggggtctcagggccagcctggccttgtgggagggtctcagggccagcctaaccttgtgagggtcttaagaccaggctggccttgtagggggtcttaggaccagcgtggccttgtggggagtctcaggaccagtctaacattgtagggtatctcaggaccagcctggccttatagagggtcttgggaccaggctaaccttgcagggaatcttgtgacaagcctagccttgttgggggtctcataaccagcctagccttatagaggatctcagggccagtgtggccttgtgagggggtcttggggccagcctgctctatggaaattggaggcaccagtcaaggagagaggcttctgtctccctgggtccttggtttccacccatccttggccagtaccttcactcctccccgaccccggaggctcctagtctgttctcctgcttcacctgccctccaatggagcccctggccatcatgggcccaggccccggagctgatccctgaccccactgttgtgcccctaactcccactctccccctcctcccctcccctcccccccacctccatttcccctcagcctctgccctctccagaccacagacacagtcctcctgaccccggctcctcctgagctgcctcccaacctctcttttcttcttacctacatttctagaaagagcagctgcatctgctattttgcagccaattctgcctcctccctccagtccctgctgtgctcatcagaggcaccaggctaacgcacggcgtgggttccaaccaagcccaggcctgaacgcactcatgccaggatgcctagctggctccgctctccccaaactcagctgctactcctcagggatcccacgacacccagccccatagaagtcccagggaccatcccagcatggccccagcacatagaccacagagcttctctgcctgaatgtcccaggaccgccatgtgatgtctcctctcccacagggaatagagccctgtcctgcagacactcaggcacaggcaaacagagacccagccattgtacctgtgggcggggatctgggctcagcacagcccacctgcccatcaggggagtgggccacacaggccaaggcggccaggcctgacgcaggtgtgcctgagacccgccttcaggaggattagccatcatagattgagacccgcctttggggggcggagggagggggggtgctgcagattgagacctgccttcaggagggtttgccatcacagagtaacacctgcccctcaggagggttagccatgtcgacttaaaggggtcttcaggggagttagccgtggctagtttatgtgtgcctacaggagggttagccgccgcagattgagacctgccttcgggggtgttgtatcgcagattgagacctgtcttcaggagggttagccatcgcagagtcagacctgccttcagcagggttagccatcgcagattgtctggtttcctacccttgagctgctcagtgtacttcaccgaactgcagtactttagatagctctactactaccgtttttgacagtttacttatatttcatttaagtttagtgggggaaagcctgggttccccagcctccttgttcactgccccagccccatgtccacatacactcctgcaactctgcaaagacaccagggtgctgtgagggtcccgtgggtttccccaggtcctcttttggcaggtccctataacatgttgcagggcaggggagaggctgtctgtgatgggcagggcccctgactgccattcgggcaagtggggatactgagggaccctgaaagatatcagggtcaggctggtagggcatgtgggcagcaatgcatctcagggagtcctgccccctcttccatgggaagggcccacagctgccatccccatgagccagagaggatgacactctaggctggtggaaagggacctgatatcaaatggaaatgaggcaacccacgaatacacaagtctgcacgtgcttctgtgcatgtgtctgttcctagagcagacacaaatgttccagaagtttctttcttagtcattcacagaatcacaggctctcgaagaaggggtattattcattctaatcagtggtgcctggaatgatgccctgtagtttctttacttgccccagacacctgcagctccctggagagagcccctcagctcctggcaactccatacgttctgtggcagctgcagggtattccactgggtaggtgggctgccacacatgtaagaggtcctctagcaaaagacaccaaggtgctttacagtctttggcaacgaaaaacactcctgcaatgggcattattgatgaaaagtttttattcaaatgtgtgaccacatataaaagatgaactcctaatacttgatgtgctgggtcaaaggttatgatcattgtaagtttaaagagacatcccagaagtgctttcaatagagtatagccaggtagtgaaaatggtggagtaaggacctccaaaaaccctctcttccataaacgcaacaagaaaaccagcaaaaaacaaaaaggtcagaatccacatttttagaacttccaaaattaactaaacgcttgcagaaatcttaggaggatttattcaaaaaacataactgaatctcagtaagaattgcaaattttatagcacttgaacttgccctagtcccatccctgactctctatcccaagtgccttgaaaagtaggaccccacattcatcatgaaaaccactggcgtagcagcccctggagggaaaacagcaatggaactctttcaaagcttcattctcagaaaactgtcattatttgacctgtccagtagttcccatggagaccccacttacaaggatgtctgtatttgacctgactcagaggtctcaagtacaaaaatcatattccccaaggttcattgtcaaaaacaattactggtatttaatttcacaaatgcctgaagcagtagataacagtgaagcaagcaatagactaaccagaaagcttaaaaggaaagtttcagtaatgacatgatcataggggttttgaaaaactgcagtgcattcctgagaatctagaaggtcaagtgcatgctcagggctgtgcacatgctcagaaaagtacttgggaaaccctaagcactcacttctggctgactttgagtctctgtgcaagcaggaagagaagactaaggcagagttatcagctgcttagctgagagctgaaagcatacccaaagacacagagccccttagcgaagactgagaactttattgactccaggcacttatgaaaatttctttccaatcattatttgaccgctaagataactgagcagagatttcagtgccacacacaaaagaatacagactttgcagaagtaatccagaaatgtcacaaaacaaacaaccattactacaataaacagcagcaacaacaaaccccaaagagtggggagaatctgatttccagaattgacttactaaacaaaaactttcaatcagctactttaagtatattttttaaagactgaaggaattgatgtttaaagaactaaaggaaagtatggaagcaatatatcaaacagagaatatcaataaaggaatacaaattataaaaaagaaccaagcagaaattctggtgttgaaaactaagtaaatgaaatgaaacatagcaagaggggctcaacaacaggtttgaacagagagaagaaagaatcagtgacttgaaaaaacgtccattgagattatccagtctgaggcacagaaagaaaaaagaaaggaacaaataaatagagccacagacaccataatggacactatcatatgtataagaagagtctcagaaaaagaggagagtgagaaataaggcagaaaaaaaatattagaagcaataatggctaaaattttctaagttagatgaaaatattcatctccatatcctaaaagttcaacaaactccaggtagatttcttatcaggaaccatgaagggcaggaagcagttgagctgacacgttcaaaatactgaaagaaaagaggtgtcaaccatgaattctttatgcagcaaaattgtcattcaaatatgaaagggaaattacctgacaaataaaatagagaactcgtcagaagaagacctgccttataagaactactaaagagagtccttcaggctgaaatagtaggacaataagcagcaacttgaaatcatgtgaaaaaataaagaggaccattaaaggtaactttactggttttatatttattgctatatattagtaaatataaaagatagtataaacacattttatgcacttaactctatttttctcctatttgaattaaaagacaactggtctatgaccatactaccctgaatgtgcctgaattaaaagacaactgcatgaaacaataattataagtatagattgatgagcacacaaggtataaaaatgtaaattttatggcagtaacagcacaaaggagaggagaggcaacagaactacagaggagcaaagtttttgaatactgttgcaattgagtttgtattaatctgaacattgacatgtacatataacatatacatagttatttgttaagatattaattataaccctacaggcaacaggtaagaaaataactcaaaaatatacaataaaggaaaagacagaaattaaaatggtacactagataatatctaaatatctatttaacacaaaagaagaaaataatgaaggaataaaggaacaaaaatggcataagacataaaaaacaaatagcaaatcctaccttatcagtatttacattaaatgtaaatgaattaaacactccagttaagagtcagagattatcagagttaaaaaaaaaaacatgatccaactacatggctttctaaaatagacccactttagagagaagaacacaaataagttgaaagtgaaaatatggccggatgcagaggctcacgcctgtaatcccagcactttgggaggctaaggtgggtggatcacgaggtcaggagattgagaccatgctggctaacacagtgaaaccccatctctactaaaaatacaaaaaaattagccaggcatggtggtgggcacctgtagtcccagctactcaggaggctgaggcaggagaatggcgtgaacccaggaggtggagcttgcagtgagccaagactgcgccactgcactccagcctagacgacagaacgagactccatctcaaaaaaataaataaataagaaagtgaaaatatgaaaaaagacattccaagcaaaaagtaatcaaaagagagccagaatggctatattaatattagagaaaatagactttaggacaaaaattgttactagagacaaagaaggatattttataatgattaaagggctaatcaacaagatataacaattacaaacaaatatatacctaacaacagagtcccaaaattcaagaagcaaaaactgatagaattgaaggaagaaataagacaattcaacaaaaatagttggggaattcaatagccccactttcaataatgaacaaaaactctagacagtaggtcagttaaaaaaaaatcgctccctctccctctccctctccctctctctccctctcgctctcgctctccgtctccctctttctaccgtctccctctcttgcagagcctggactgtactgccatgatctcggctcgctgcaacctccctgccttgggctccggtgattctcctgcctcggcctgccaagtgcctgggattccaggcacgcgccgccactcttgactggtttttgtatttttggtgcagacagggtttcgctgtgttgaccgggctggtttccagctcctggcctcgggtgatctgcccacctcggtctcccgaggtgctgggattgcagatggagtctcgctcactcattgctcaatgttgcccaggctggagtgcagtggcgtgatctcggctcactacaacctccacctcccagccgcctgccttggcctcccaaagtgctaagattacagcctctgcccgcccgccaccccgtctaggaagtgagcagcgtctctgcctggccgcccatcgtctgggatgtgaggagcccctctgcccgcccgacccatctgggaagtgagaagtgcctctgcccggccgccaccccatctagaaagtgaggagcgtctctgcctggccgcccatcgtctgggatgtgaggagcgcctcggcctggccgccccgtctgggaggaagtgaggagcgcctctgcctggccgcccccgtctgggaagtgaggagtgcttctgcccggccgccaccctgtctaggaagtgagaagtgtctctgcctggctgcccatcgtctgggatgtgaggagcccctcttcctggccgccccgtctgggaagtgaggagcgcctctgcccggccgccccatctgggaagtgggcgcctctgcccagctgccccgtccgggaggtgaggggagtctctgcctggccaccccgcctgggaagtgaggggcgtctctgcccggccaccccgcctgggaagtgaggggcgtctttacccggccgccaccccatctgggaagtgaggagcgcctctgcccggccgccccgcctgggaagtgggtgcctctgcccggccgccccgtctgggaggtgaggggcgcctctgcctggccgctgccccatctgggaggtgaggggcgtctctgcctggctgccccgcctgggaagtgaggagcgcctctgcccggccgctcttcgtctgggaggtggggagcacctctgcccagccgccccatctgggaagtgggcgcctctgcccggccgccccatctgggaggtgaggggcgtctctgcctggccgccctgtctgggaggtgaggagcacctctgcccggccacccagcctgggaagtgaggagcgcctctgccaggccgccccgtctgggaagtgtacccaacagctccgaagagacagcgaccatcgagaatgggccatgatgacgatggtggttttgttgaaaagaaaagggggaaatgtggggaaaagaaagagagatcagattgttactgtgtctgtgtagaaagaagtagacataggagactccattttgttctgtactaagaaaagttcttctgccttgggatgctgttaatctataaccttacccccaaccccctgctctctgaaacatgtgctgtgtcaactcagggttaaatggattaagggtggtgcaagatgtgctttgttaaacagatgcttgaagacagcatgctcgttaagagtcatcaccgttccctaatctcaagtacccagggacacaaacagggccgaaggccgcagggacctctgcctaggaaaaccagagacctttgttctcgtgtttatctgctgaccttctctccactattatcctatgaccctgccacatccccctctctgagaaacacctaagaatgatcaataaatactaaaaataaaaaaattaaaaaaaaaaatcagaagacttgaacaacactttaagccaactagacctaacagacatcgacagaacactccacttaacaacaacagaacacatactcttctcaagtgcacaggaaatattctccagaatagaccttatgttaggccataaagcaaatctcaataaatttaaaaggactgaaattatacaaagtatgttctgtgaccacaataaaataacagaagtcaacggcaaaaacaatctgggaaatttacaaatatgtggaaattacacaacatattcttaaataaccaatggaaaaagaagaaaccacaagggaattctcaaatttacttaagtaaaaatactatgaaataaatggacatgaaaacataacatgccaaacttacggaatacagcaaaagcagtgctgagtttaaaaatatatatataaaactataaatgtccacattaaaaaacagaaagttctcaaatcaacaacctaacattccaccttgagaaactaggaaaagagaagcaaattaaattaacaaataacagaagaagaaaatactagagtgaaagtaaatgaaatagagagtaaaaaaaaattgagaaagttaatgaaaaaccaaaaatgggttctttgaaaaataaaactgacaaacttctaactacactgaacaagaaaaaaatagagagaagactcaaattagtaaaatcagagaggatattaccaccagctttacagaaataaaaagcactataagggaatactatgaacagctgtttgccaagaaattagataaactagatgaaatgggaaaattcctagagaaacacaaactctcagactgaaacttaggtcagaataaacctataacaagatattgaattagtaatcaaaaaacttcttgcccacaaagaaaagcccagggccaaagtcactggtgaattctgccaaacacttaaagaattaacaccaatcccttacaatgtccttcaaaaaatagaatacaaagcactaaccaattcattccatgaggtcactattgccttaatactcaaactaggaaacaaaatcacaaggaaaaaaactataaaccaatataaaccatccataaatgtagatgcaaaactcctcaacaaaatattagcaaatcagatccagcagcatattttgtaagtattcatcatgactaagccatacgtattcaaggaatgtaaggttagatcaacatacaaagatcaatgtaatataccatatccatagaccacataatcatcacaatagatgcagaaaaatcatttaataaaatccaacatcctttgaagatttaaaaaaatgctcaacaaacaagcaactgaagggaacttcatcaatccaataaaggatatctgtgaaaaatccagaacatcacagttaattgtagaagaccaaaagctttcctcctaagatcaaaaacaaaacaaatatgtctgctcttgcctcttctatttaacattgctctggaggttctggcctcggcaattggataagaaaaagatataaaagacacccatattgaaaagaagaagtaaaactatctctatttgcagatgatctcatatataggaagtcctaagaaatacacatacacacacagacacacacactattagaactaataaataaattcagcaaggctataggatacaagatcaatatatgaaaatcaattgtaattctatatggtagtaatgaacaatctgaaaataaaattaagaaaacaattcaattcgtaatagcatcaaagagaataaaataattataaatttaacaaaagtataagacttgtacactaaaaactacaaaacatagttgggagaaattaatgtagacttaaataagtggaaggacatcccatgttcatggattgtaagacaatattcttcagatggcaatactccccaaattgacctacagattcaatgcaatccctatcaaaattctagctggcttttgttgttgttgttgcacaaattgacaagctgttcctaaaattcgtgtgaaaatgaaagggacctggaacaaccaaaacagtcttgaaaaagaagtacaaagttggaggactcacatttcctgacttcaaaacttactacaaagctacagtaactaagactgtgtggtaatggcataaaaatagacctataaatcaacagaataaaggtgagagtccagaaataaacccacacctccatggtcactcaatttttgtccagagtgtcataataatctaatggggaaagaatactctcttcaacaaatagtgctgggacaagcagatagcctcaaacaaaggaacacatttggatttgtacctcgtaccacatataaaaatgaattccaatggatcaaagacataaatgcaagacctaaaactataaaactcttagaagaaaacaagtgtaaatctttgtgaccttgcattaggcaatagtttcgtaaatatgacaccaaaagcatgtgcagtcaaattttaaaagagataaattggacttgatccaatttgaaaaacttgtgcttcaaaggacactatcaagaagaaatgggaaacactaccctcagaatgggagaaaatatttgcatgccatatatgttatagggtctagtatccagaatatatgaagaactcttacaattcaatgataaaaagatagcccagttaaaaacgggcaaaggccctcatggacatttctctaaagaagatgtacaaatggccaataggcacattaaaatttctcaaaattattagttattaggatttcaaatgcaaatcaaaaccacaaggagacactatctactggggtggatataatagaaaagacagtaataacaagtgttactgaggatgctgagaaactgaaactctcatactttgctggtaaggatgtaaaattgtgcaatctattcagaaaatgatcggtatagttccttaaattgttaaacagagttatcataggacccaacaattccgctccttgtattccacaaaatatttaaaaacctctgtccacacaaaaacttgtgcacaaatgttcacagcagcattcttcatattagccacaaagtggaaacaacccaaatatccattaactaatgagtgtggtttatccatatgatggaatattacacagcaataagaaggaatgaaataccaacatgctacaacactgaagaacttgagaacagtatgctaagagaaggaaatctgacaaaaaaggccatgttgcatgattccacttattcaaatatccagaataggcaaattcatagagtcataaaatagattagtggttaccagaagctggtgggttggggaaggggcagtttgagggataattaagaagttctgggctgggcgtggtggctcacacctataatcccagcactttgggaggcctaggcagacagatcacctgaggtcaggagttcaagaccagtctggccaacatggtgaaaccccgtctctactaaaactacaaaaaaattagccagccatggtggcacacacctgtaatcccagcactttgggaggctgaggtgggaggatcacttgagctcaggagtttgagaccagcctgagcaatatagtaagaccccccatttctatttataaaaaataagattaaaaaaaaaaaaaaaacatggccgagtgtggtagctcatgcctataatcccagcactttgggaggctgaggcgggtggatcacttgaggtgaggagttcgagaccagcctgacaaacatggtgaaaccccgtctctactaaaaatacaaaaattagctgggcatggtggcacatgcctgtaatcccagctacttgggaggctgagcccagagactcgcttgaacctgggtgacagaggttgcagtgagccgagatggcactactgcgctccagcctgggcaacagaatgagactatgagactcggtctttaaaaaaaaaaaaaaaaaaaaaaagaggttctggaattagagatgatggttccatttgtgaatacactaaaacccactaaatcatgcactttaaaagggtaaaatttaagttatgtgaattatatatttcaatttcttagaagaaaagatgacgatgaccaacatcccactaccaggacagcactcgatgaccctcacaggcaccacaatctaacaggtgagaatggtctcactgcaggcttaatttgtattttgttcattatgaatgacagtgagctaataaggcatttttttttcttgaatggtgtgtttggggtttcccctttattcaactagtctgtagatttttttcttattcatttttctttggcctgagtttaaggctaggtaatggtattcattcatccaataactgtatcttgagggcttagggttgcctcgccctgttctaggcagtggaatatggtcataaacatgacccacagagtcctgggcctcatgaagcataaatggtcaaggggagacacaaatactaaacagggaaacacacaccagccggcaacaagtgctgtggaaaaaactagagcaggtggggagagccaggagtggatgggggctctgttggtgataatatgggccagctggagaaggctcctcagatgaggtgacttctcacccacatgaagcaatccacgtagggaagaactgaccccagaggaaacagacactccaggcaacagaggaaagcataaaaagcaattgtaagggagagagacctggtcacctgtgtccatctgaggagcaggacgccatggctgagaatcaaccagactctaagaacagtagccaagacctgtagccatctcctcactgccccacacccacaccactgccagctcccacctgctgctgtgctacccacttcccacgtctgaccatctgtatgtccatcctccctggtaagccctcatccaagtggccatccactctccaatgcagggttgcagggcccccactccaccccagctaaccatgctcttctgagtcacggtcctgggggaagggggttctgttggcctcagcttctgaaagcacttccgtggctccaagaaggaagacagtgctggtgatttggccagcaaggcccagcctcaccctctctccccattgctgttggctggctctgctcccccaggcacacagcggtgcagggtcctgcccaggccagctgacatcactgccaagatgggactgaaatgtcagtgtctgcacacagctcgggccagcaaggcatcctggaccctggctggccctggggcttcctgttccccttgcctgccaagcagggccaactctgtgtccctcagaaggagccagctgggaaggcctgtggtcaggaggaggtgggccccagagtgtcccccaatcctcagagtccaaaacagaggatgttcctgcccccaccaccggcccccacgccaggaagctgctgcagccaccagggtctgatgctgcctaatcagggaaggtgctcctgcagggactttcacgtgtgtttaaaagcaagatttaaaagcaagattattcagtgctctccctcggggaaagtcccctggggagagggcacagtgctcacagcagggtccagcggccagggcaagcacaccacctctgtgtctcccaccgagggagctggcaaaagcccttcacctttctgaacttcagtttccacttctagaaaatgtggtgaatgccatgcacctgaaggaccggtgcagctccctgcgaggcaccttctctggcactgtgtacccttggccaatgcgcagtctcggagctatggaggagcgctgcctgggagccagctgcccggacactggtttcactacagctggggagaggagggccacctggaatgggggaatggggagagcacctgtcatggacacacctgagcagctatgacggtttccctgtcgggggacgcagagaccacctcccaggtccatatgccatcaccagccataggacacagtcgtcccagctgacccaggacagtgccaattccgcctgttgcttgacataagtcactctcagaaagtgccccaccccacccaagacgactgctagaaacagattcctgggctccgcccccaggccgagtgaatcagagtctgggggtgtggctctgaggttggaatcttctgccagctcagtgggagaccccagcacacagccagacttgagaagccccaagtgtggggtgtgccgaaggggaaggggggggtcaggcaccctagagggttccttccatgctccattccacagaggctccttgcttacatctgcccctcacctagccccaaggtcaggtcaaatgtcaaaagcacatgaggggcattgtggctccgctgttttcccacctgtcacctggtcaatggcggcttcccagctggaaggggcagagagggctggaggcttgggagtggtggtcctggggaacaaggctcaatggacccaggcactgacccgcaaccctgctgaagccagagacacctgggtggaggtggagacgtgcaggcaggagctgcccagggccaggcagaggctccagcagcgagcctcacagctgaagggaatgtgtgaggaggggcctgggccttgctctagggagcacctctgaggctgcagggcgtggaaggaagtgcctattccctgatggaggccgggaaggtgccagaaacccagaaatccaacaggaagggctgcaggaagaggcctgctctgctggctgggccctgatggcactcttctgcaacccaacctctgagactcagttttccttcctgccgcagtcccagcatgcagcactgatcagccagcggcagccgcctggggccctcatgaaaagcaccctgtgggttcggcaccaggtccctaatatccccccaatatgaggactgtgtgcttcccatctgcaccccgctgctgcctgaagcgtcttgtggggcccctcaccgtgctaggatttgcacctcagctggagtcccctaggaggcacaaaggctggagcaggaacagtgtggcttccagaacacactcacgcatgcccaggaaagaaaaagccacacagattgatttactgcttctgctttgccactgagcacaaggtgtcagtgtgcatgatggacgccagccgctgtgaaaattgagatgtcagcccagagcccacagcccacaccacctcacctccagacgcagtcaggggtggcacagtcctgttaattgcgagccctgagcagactgcgaaacgtgcttgttgagcgctacctggggagctcaccctgtccagacggttgggaatccacactctctggctcacgggacacctctgcttctgcctccctgtgcacagccacccctccaggactgtgagggggaccaggccttcgtctggcccagcactggtgtggaccagacccctgaccctcacaagtaccagttctctccttgctgttgtcaggttcggaagggacaggtgaaggtgctgtgccacagggagtctccccaacaagacggacccctggtgatgcaggagcaggcagacagggaggccctgctggatggtagcggcaccctgaggacacacagggtggtgtcgagctcccacctggccctggccatgaggagtgttgtcagagggtgaggacgcagagggcacctgtcgccattgatgctgggatgaccaaggacagtgcctggggcaggcccccagaagcagagggggcttgggggaatagagggctgacccaggcactcctgtgtgtgcacggtactgccacccacccacatgggtgtgcatacacaggcacactccacatcgtggacacatctttagtttcaagggtgtcagcaggtgggacacagagcagtgcaccccagaaggagcagacagaccagcacacccacctctccacagccaggactaggtgggcaggggaaccaggccaggagtcaagggcctggccaggcacttggagttggaaggcagggaggaaggggtgggctacggggctgcgggacaggccggggctcggcatccagcagctctttctagtaggcaggcctgcctgggaaggaagggcagggcattaatgggtagtcagtgactctgtcttccaaacccaactgcctggccaggcccttgacttctgcttagccatggactcccaggaagggaggggacgtgactgtgaggcagacacagtgcactttcttttctgaaggtctgatttcccctcacatgtcctaagctcaggggctttttagcacagacagaggacccggtttcagggctcggctgccaaactcacctgactcccactggcaatagagcccctccacagaggcttgcaggctccctctgctgcacacccagtgactggctcgcggcgggaggcagcacccgagagaggaccctgtgcctcctgctcaccctcgacacagacccactgggactaaccgctcccctgcaccctggcactcatcgtccgcaccccactggaacccacaatctgctgccaacaaccccagctctcctcacagagcaccgcaccccacgccttcaggaccagcgagttcaaaggagcccatcgtgggcaaacccccatggtctcctctgtccatgccccagacaaaggggctgtgcacacccagcccagggagggcccacaggcgggggtgcccccacacacttccacgcccaccgtagcaaggccacctgcaggaggggcctggccaggtccagccttcctgacacccaccccacaccccccaccacctcatcctgatgtgttcagcgggtgccacaacctccaaactaccccgtgtgtggatttgaggtccttgtagctccccagactgtaaactcccaaatccccggggagggctgccttgctcacctcatgtgagggattaggctctcaagagtgggtatggcccccaaatatgcccacagcctgatctccagaacctgggaatgttcccgtattcggcaaaagggactctgtaggtgtaattaggcagaggctcttaaggctgctgggagattctcctgggtgggcccattgtattcacaagtccttaaagttgaagaatctttccccgctgcagtcagagaaagtgtgaggacaagacagggtcagggagatggtggcgtcaggggacccaacacctgtggctggctcggagctgtagggagcctcacacaaggcccagagggggctctaggggccctcaggggccaacatcccacaggggacggggacctcaaggaatgagattctaccaacagacacctgcgtgaccacgattctgcctggagcctccgaagaggcaggccggccagcgccttgacctcagcccctaagacccgacccagcctctgacctactggccgagataagaagcatgtggtgcggaagcagctccatctgtgggacttttttgcagcagcaataagaggcaggggcagcccaccctgctttgagcaccagccggctggccacaggcacagaccacaggggcaggacccctctagggctcacccggcagtgcccctaagctgggcctggggcaggcctgcctccccatggggtctggcaccatcctccccaccctcaggcccacagagggcagacggagactcacatgccaggcccagtgctcggtggatggcctcccaccagggctgtgctctgtgaccccagctgtgcaaggaagtgggctgcaggaaaatatcccctgcaggaaaccctggagccaggacacttcagggagggcgggagacaaacagagggggccttcagggtcctcttgggaactgcaatgtgccagtggcaccaggacagctgtggggccatggagggctgcaaggggccatgtaggtagacccccccagtgctggcggcctccacttgttgcccccttagatctgtgtggtggggcactggccctcctgctgagggcacgggtttcctaacaggcacctatccttcaagctccttgggcctggcccagaccttccagccctgtgggctgtgctcttcctgctggtcctgcctgccctctccacctcgggcctcacggctgcaccgctaacccccgcccccggacctggtctactgttgcagggcccggaactgacaccttcacactcaggtcacagcgcagtgacacccggcctctgggcctcagctgctggcagaaggctgggtgggggctaggtgggggctgggagtccataaggctgtgctccctgagcaagtctctgtggtcacaggcaaggatggaaaccgctgctgtagctcagaggtaaaacgggtctctgtgggatgagctccaagcaggggtccaagcaggggctcctcctagggtccccagaataatccctgactaaagggagggaacaaaggagacagtccctttatggcacacaagcaatgacaccagtgactccattgggtctgacattgggacctccttgtgtagctggtagccccagggcccactggaggcccctctatccccgcactcctgacacactcggctgggaacactggggactttcctcctgggcagaggctccccattcccaggcatctggagaggaaaccgggaagtgtggggtttccagcacctccgggaagccccagccaccacctggtctctgcctggcagagtccagccccaccagcccagcccctccagccggtgtcgggcttggctgcagtgggaatgcccagcaggaaggacagcaggatccaggaaatctcccaaagtcactatgctgcacggccccacccaggccccagcgccctccaggcccctcacaccacctaggccaagccgcccagccctgcccgcctaggctgcccactcagcatcgctccttcctgccccacccactgccatctgggcctggacggctccaggatatcctggacagtggggcaggctgaggtgagagagctgaccactgtcctgacccagccccagggctgcaccctcatccaaaggctggggacagctgcccccacctcctcttaggctgcaagctctgggggcaggcacactcctcactccttgtctcacagccctgcccagagcctgcacctggagcaggacaggaacatcacagctctgccatgtaccctctgcagccaccactctgaggaggtgaggagtgtcactggcatttcatagcagcacagactgaggccagaaaccggaagtgtctgtccaaggacacaggacactggtcagggccagagttaaaaccaaaacccagactcccatgtcaggggaaccctggagccagggctgggggtgctggggtgggagtaggcacaagtgttggctcaggaccaccaggtggtgggtgtgtggccattcctgggcacctgtcacccttggcttctctgggctggctcctggcgctgtctgcccactggcaccccactcccccagaggagcaccagtctagagtgggggtgcagtgtggtctgggcttctccgatgccctccttcctcccctggttgccaacaatgctaaagctgcacgcctgtgatcagggaggccctctcagcttgactgctctctcctgccccctagagctaccatagtgtttagacagaggccatccccagcctagggggagcactgtgcaggaggaggcccccaggggacccagagtgaactgactttagggagcccatgctaatgactgtcctggccacactgtgccccacaagccacaggtggagtgaggatgctgagggggcctggagccaggacaaggcaagccaggcgggggcaggtgcggcaggtgctgctggagtcccccaacccctacccagaacacacagcagcctgcatccaggcagccagtgcggagcttggttcttgatccggctgtgactggctgtgtcctccctggaccatgtgctcagagatgggacaagggctgagcggcttgtcacaggcagaaagaagaacaggaacaggaacctcagggaaagaaagggctggttgggggtggagggggtggtgaatcaatagccaagggaggtgggtgaagaaagtgaggtgcagcaggtcaaatacgcagaccagagtggcctctccaggatccctgcccacattgtaatgcatgggctacctctctcggcttccagggcactgcacactcagtgcgactctggacctcagccgcttcccccacacagtctcccgtccctggttctctccacgttggggctgaggatgtgtctggtgtggaccagcgcacaccacagccacagagcagtgcccccactcgcgccatctgcacacagacacagatgagccgtgaaggtggcatgaaaccccgggcctctgttccccgactttcttgccattccctggttgccggcaggagtccatcttggggcccagctgtttcctctacaaccggaaacccccttcctcccttcatggttttgcccaaacctggccttcccagggtggctgccttcatcgctccctcctggcacctctccctccttccagaatcattaggctcatttctgtctatttttaggttgtgtctgcactcccagagtctgggccatgcctggcgtgcatggcctgcagtgggtgaggttgtgatccgacatctctccccaggtcaactttccactctccaatggttctgcctgagtccatctctcaggtgggggtgagggtgagcagcaccttgcagaatccctcacatggctccagaggtcacagcaagagggaggagccatgaggcctgggttcacaccctggactggccacttctcgttatcagcaccagcaggactcttgacccctccaagcctcgctgacacactggtgatgatttgcatgcccaccctgggcccacttgtgtctagacacccctcaccaggtgggcagctcatcagccacatggggccttgcccagcgagtcccacccatgcagtgtttggtggggaaggaggagcacaggtcccgcccaggaggcaggattctgggactgggcctgcctctgccgcctgggggcctctcctccacacctcagtcccatctggcctgcaggcaggttccagcaagctacattctccttcctaggagggtggggatgttctcagaccccgtagtgccctgcgcttcccccgggcctccccagggggtagtgactgcacacagcgatgggcaacaacagggtccagggtcccgtcagcggtgccctccccattctaaagcaggcctgggactcacattctccagagccagccctggccctgcattatgctgcactgaccattttcacatgtgctgtataatgtctggttgaggccaggggttctcccctgggctcccacagggctgcatggctgtccccactagccagggaaaggtgtgtcccctaggactgacagacactcctcccaccatccaggcagccagtgctctggccgaggcagacagctgcagcctggagaggacagacagggcgaggcaggggaaggcagctgcctgggccaggacatgagggcctccagtgttacatttacaggaggctcagaaaacaactaggctgggcaggtttccagtgggcatctggggtgaactccttccccattcaggatctcaggcgaaagctgcctctatactaggtggctcacagcttcggggaggggtaccctcatggaggtctgcctgctggagcccccagaaccctgcgccagtcaactcttcattgaaagatagggaggcgcagtttcgtttaactcaattttgcagcctccatcatctgagtgggtgggtatggagtgtctcatcttgaggtgagggattctgtgagcgggaggaccccatggctggcctggcctctcaggaggctgaggtgagggggctgtggaaggtgaagtcgcccctcctaatatggcagcaggagggtgaagtctagcctcggtcaccacttcccctgccccatgccacctgccctcctctttcatggccaacccagtgccccacctacctcagggccatctgccactctgcgcttgacaccagaggacaagtgcatttccttggggcaaagctgcaggccacagcaggcggctggccccttgggacgaggagagcagctcagttttggtgggccgaggggcaccaccagcagggagcctcagagagcctagcaggcttgggtgagctactgagctgcaggcttgctggatggatgccccacaggccagcccctaggagcaggactgcctctgtctcctctttgtgccacccacacccaccatccacccactcagcacagcctcttcatgcctggtgggctctcagggcagctcatgtgctgccacctgggctggccctcctggcaagctggaagagctcactgggcacatgggcctcctgaccaccaggcccgggaaggacagctgggggccagagtggagagaaggctgcagcaggggctgatgtgcaggccccagactccccggccagtgctccccaccctgcactgccttcactggcctggggctggccctggtctctggttcccccatctctggcccatgcagcctgagcccagagttgacaacatgaccatcagtcagtccttccctggacaaacagacaaagctcctcatgccagcacaacacttggtcccagggctggcagccaggagcacagagaagaacccacagacactcacagtgaccccaggaagacagatatccatgcagtgtggcagtgctgtgggatgcaggagcaggctggacctgaggttgcattctgagcaccccagggaccagctgagggcctgcaagcacagcgggtagcctcttttctgggggtagtagcagtggcccctgggacttgcagctgggccctacccagactcccccagggctgtgcagcagtcatccacacttgcagccttctgcagaagactggagtgccagcatccaagggccgagcagtgcaggggcctgactccaactcccctgcctcagagggaggctagctgtggggtcagttgacactccggagtccccatggaatcaggctagacttccgctacaactgcacttctgtccagcctcctcctctccctgcatggtgcttgtccttcccacacagatgtctcctgagagcataccctctctaaaccccttctatcagaatccccagcccatgcactgagtcatagccctcacaggcaggaacgagatgagagggcacagaacaagcactcagaagccaggtgccaccgctgcacgttcaggggctcaataggccagaggaggggggcgtcctcacctccaggaggtggaggtgctccccactggggccatccagctgagccccaaggtgggagtgtgcattcaggaggcacacaggcaggggaaaccactcacaaaggcaggaagggggatggccagctcaggagctggacggaggggcagggcggggacggcaggaaggctcggagagatgaagggaggcaccagagaaccacaccacctgctaacatgctccctagagcacgggagcgacctggcctcaacctctgcctctgcccctctctgcagaccccagaggctcactggcaaaatcagtgtaatgatgctggcatcaaaaagaggcacattaagtcacatgtcagtgaaacgcccagcagagcccttggacagtaggctggtcaggggccctcccagcatctgggtataaatgcacacacccagaatgaatgtgtacacccagagcccccaggcacatgactgtacaccacacccaggcctgggcaccggcagggtggaccgagggcaccagcctccccacacctgctgctccttcctctccactctgcaacctgggccctgcctggcactggtgctgtcctggagatcccctcctgtgtcttcccctgacagcgtccccggttgcctcacataagacagctctgcactcggtgcaccaccggatgcatctggcgtcctgcccagggctgagaacactgtgctgccctggagtccaaccctgggtgctatggcaggccagagagccactgtggaaccctggtccccacgggcagggccaagtggctccccagacccagaccccacggagaagctagggtccgcccccctctcaggaccccagcaggcagactcccgtgcccataggaggcctggccactgtcccgccccctcccacctttcccactgcgggagccaaggaaggcacctgggtgtggacttctcctgtacaactgggctctccagacgtcagcaggcagcagggcatgtagccctcgacggccgtgatccacagcgctcagcattctatttttatcatttaaccccaaactttctattccattgtttctttgacccatcattcaaacatgtgtttcaaattttctaaatatacaactcttttagagttatctattttgttatcactttctctcttaattgcactgtagtcggaacacttggcccgaatagcagcttctttgacatttgtgcgggcatctccgagccagcactgactgctcagcctgtgcgcacccaccaggcttggtgggtgcctggtgaccgcagctgtgggtctcccctccaggccccacccatgtgggagcgccctccccctcggccccgccccctctgggaagtggttctggctgccgtggcctttccatgaagaacagctgggacccctggccatacttgccagcacagtttactatcagccctctccaccaccaccactccccgcagggcagttgatctggcccaggtacctgcaggtcacctcacagcaggtctaactcactccagcttggtcaaggtaagcccagctcccagaaacacctaggccagaggaggaaggggcacggggcatagaaggccctgtccccgtagcggggctgagcaggaagggccctgcctgcaatggacagtgtgggcaggacttgggctctcccaggtgccaccaatgctcacctggcctggcctcgccagtgggggactccactcctcatccagccacccactgctaacagcaataataaaatgaataattgatgcagccccctgcctgctctgagtaattaactcatgaaagcatcagggcacccccagaactcccaacctcatccaagccccatcctcccagctggtccactcaccctgcctccagcccacccttcctcccccagctctgagggcagaggcttgggtcctagcaactggggccaaccctcctctcctcagccagcaaagccggggctgcccagctctcacccagagcctggctcggggctgcacattaccttcatccagaccacagccctgggagaagcagggctcacagggcatgctcagagcaccggccagaaaaagctgggcacagaactagcctacagagaagtccaggcaggagaaatctggaccttggagtctgcgtctgtacagggacaaagtgcagatcctcatcctgggaagtacctggtgctgtggctgggcatgtctccccaggccccaaggaggaggcctgccccagtgccccagctgtggctggggtccaggacacacccggatgcactcaaggctgcctgacattcacatttggcgggtctgggtaccagagacctggagagccccatgggcagagagagtgggggagggtccaccagatttgggcagccttggtgggggtggggaaacaagccctgctgataaaccatcagaacgcgccccctctcctctcccagctcccgccagcctcctccacggaagctactctttgttaacagcgttgccatggcaaccagatccagggagaactctctcttcaaggtagagtctgagggtgacacttggagaaacagaagtggtggtgacaacaaacagggtgctggcctcccagccccaccccccaggattccttcctggtccaggaccccagacaccagccccccagactgtcccagagctctcaggtctgcttccctctcctctcctctccctggcgtgggtgcagcaacgtggcccaggccaggcacctctgccacaccatgcacggtggctcaggcacttccatgcacctcccacggatgttcgctgaatctgccagcatagccactgtctcgtggctgggctccaacaggcctggtgcagactagaccccaggggatcatagacaagtacacccaaggcggctgctgcagagcagccccgggccccctgcacagcaggaaagttcaggaaggcacccaaggaaggctgggagcctcctggcaggagggagacccagcagaagccatgccctgagtaggggaacagactgctgggtaaggaggccactgcaaatgtcctggccaggggatggtggcccggcccacagaggtggcagtgagcagggagaggcagaaggggcagaagagaggtctagagtggggtgtgctagactggctgacaactccaggcaaagggaagctggcagagggggtgagggagagccagctgcctacctgctcagatggggaacctggggcaggcaaggttcaggggcgtgatgatgtgcatcgtcacccgggaggcgtccagcaggctcacacactgacagaacccagaggacaggtgggggctgatgagagctggaaccggatcagcacggaggagggaacagatgctgtggctgggtagagggtttgagcccaggtcttgaggaacagggactttgagtgtcccaggatgggaggaggagaaccaggggccggccaagcccaggaaatgggtgtctgggaacaaggcagtggacatccacggcctctcaagaagacatccctggactgaaggaggtgtgtgcagattggcgtgggtgggagtgagtgggaagtgaggattcagagtgagcagagaacatgtcttcaaagtcagcccgcacaggcgaccagggtgcggacggctgagcaagtttcgttgtttttaaaaaaggaaaagcacctgtcaaccggacagccacatctttgcatcccacgtatgaagtgcccaccctgggctgttctgtctagagtcccagcccaggcctctcttcttcaagctggtgctggcctctgctccctgaattcacaaagaaccccacagccagctcacaagagacaagcaggtctcggagcccctgctggctgccctgggcagcacaggccggcagctcagcccctaccccagcccgggcagtgcccagggcagggcgggcaaccacaggtggggagaagcttcccagaacaggatcactgggtgtcgtcctgagttgtgcccaaaggcacccatgtgcttcctgggaggtgctgcagcagagccgggacaaccggactactctccctgcctggcttccctctccatggtccaccgggcaggggtggccacagcagcagtcacacccccaccccgtccatcacagcacaggccccgcttgagtcctcacacctgtccactcctggccggtcacccctcacagccctctgtcatggtgcctggagcagcctctaccagcctgtcccaggtggtgagccctgaggccagagcccctctcccactctgagcaggccaggaccccgaggggctttcgggcttcccttcacacagtgcccgccaagccactgctggccataccagctgaccttcccaaaccctgctcccgggctgctagctggggaattcctggtgtcccagcgcgcagggacattctgcatgggttcctggcagctcgccactctgggccggcccagagcccactctcacatacccacagccccaggctctgtgcccaaaaagtggcgacagggatacacccaaaaagtgggcagtgagccctctctggacccccgcaggtcaggctgacagccataggggagggcctctgacacccccagcaatccaccagtgggtatcagaggccctcctctatggctgtcagcccaccagtgccacttcagtcccctccctccgcacatcacacccttgctaggtaaacactcatcctccccagcagggagtgggcaggggagggcagaggagccgggaggcaggctggagtgggtgggagttacaggaggcagattggaagctccaacagaaaagcagccagagtgccggacccaagcagatggcctcaggagaaaaagggggaaggggagggagggtccgtcaaggggcagcagggaggggtgggggagaatgccttgagtctcctccccatctgctatctgctatgcccctggcacctacccccagcagcccagcgcccctcccctggggtgggccatgcagagaagagcatccctccaccagcccctctcctgaggacagtgggggggccaaaccccctgcccccatccctgccttggcacagcaccttcacttgacctatttgacaaatagggcttctgtgaaacccacggttctattgccaaaaaccaaaggccaaccaaagctgtcccatcctgcccctggcatcattctacaggtggggaccggcgtgctcaggggctcctggccacactgtgtcccagtgcccactcgctctcctccctggctggcccctcccaccgctgggggccactgtgtgcgtggctctccccaccgcagccactgtccagcacaaatgccatttctccctcctcctcctcctcccctgcctgcagttgctaagttacaccaaaaaacccctctgctctgtgtgaactgttccatttccacgatttgccaggtggaagggagccatccggctggcagctcgaagatgcctcccagagaaaaacaaactcactggctggccttcaggccaaggcacacctgggatacctgcttggttcacaaacccaggggcatgtgcaggaggacacagcttctctacttcactagagagcctgggggatccacacagctcatgcccttctcaggagcagggagtgtgggcctgctgcacccgcctcgctgggtcactaccacccacagccctaaggacacacactggctggaggggcagagaacccacccacgtgtccctggccatccagccaaggtcctccatgtccccctgctccggatctccccttcctgggctggggtcctgaggttccaaagcaaagtgtcactggacatcagggtggaaatgtcctcagaggtcatcaaaaccgtgtcagtctacagatggggaaactgagtctcagaagcctgcagcctgcccgtggttcacgaatcaagacctgtagcctttcggctggaggccccctagagccgcttagagtccagggcaccgaggtggacaggctgggctggcaagactgcatccggagggggcgggagaaccctggggggacagagggaaccaaggcctctgggaggctcccctgcacccagcctgactcctgtgtttcaggatcctgcggccgacggccatcggggcccttcctgcgcaggacagtgggagaagagtggcagtggtggggagggtgaaccagggagaagctcactgctctgagcagggagggagggagccccggccaccaccaggtctctgcccccaggtggctcccaagaggcaggcagcggcctctctgtaaatatccaccaggtccagcacccagaggcagccagaaatgcagggcacaggaacctgccagcgcgtccctccacacacagcaggggactcccgcccccacctctcactcaccgaccctcggaccagaaccagctgcacctgccccgttcctggggccggcaaggcctggggcaaagagagcgtggtccttcaaatgacccttgcccagcagggagagggagacacctggcatggccctggacctctcccccaaatgcagagctcaagccccaattcctcgccaaacagcaagggcgtgagataccacggcggggcccagaatgcagaagagcaaatggaaacttccaactgcgcagccctgagctcctccgattccccagcccccacccccacgccaggccccgggcagcgaacctgcccgcagtgcccacgcccgcccgccgcgtgcgctcctgccacgcccggcccggcccggcccggcccgccaggtgccctgaaggggcggagggtgcagggggtcctggcgccgtccagcccggggcggagttctcagcaactccgcgcgccgggatcccggccgccctccccgcgcgcgtcccccgccccgcgcccggagcccgcgccccggccccacgacggccgcgccgggagggaccccgggcccgcgcacgccgcgccctgcccgcgccggcgaccggagggcacggccccaggcgcgggcgggggccccgaggcactgagggtccgcggccgctgcctacctcggtccgggccagcgtcgctcccgcgccgccctcgcgccgcagtcgggccccgagcagcgcgcggccggcgccggcggcggctcatgctcggcgcccgggcccgcggcacccgcccacccgcggccgcccccgcgctgcgccagctgcgggcagagcagctccctccgcagccggcgccggggagcgcgagcgagcgagcgaacgagcgagcgcggagcgagcgccgagcgggcacggagcgggcgcgagagcgcggggagcgggggagcgggcgggcgcgggacgcggagggaggagggtgcggggcaaaggtgcagggggaggtagggcgcgggacggggctcgagcagagggcactgggacagggcgggcgccgggagagggcggccaggctttcatttaaaaaggataaggcatcacgcctgtaatcccagcactttgggaggccgagacgggcggatcacgaggtcaggagatcgagaccatcccggctaacacggtgaaaccccatctctactaaaaatacaaaaaaaaaaattagccgggcgtggtggcgggcgcctgtagtcccagctactcgggaggctgagggaggagaatggtgtaaactcgggaggtggagcttgcagtgagccgagatcgcgccactgcactccagcctgggtaacagagtgagactccgtctcaaaaaaaaaaaaaaaaaaaaaaaaaaaaggatcaggcagcagacaagctaggaggcgatgcggccaccgcatttaaaaggccctctggggactcccgcagagctggcaaaatttttgtcagtggaatcagacggtgaaagcccttctgtgggcaagtcctggccccttgggtcactccccttaaccatcttaatcgccctgtaaggtcggtggtggatttgttcccattggacaggttagtaaactgatgcacagggagtgcggttaccctgcagggtctcagagcctataagtggcagagcaaggctccaaagccaccttgaaagatttcagaaccactaaagcaggacacaggtcttctggcgtccactggaacttcctgtcgctctgaagggtcaccttctcttgaacggacaccctgtggcctgaccccagggtggcccagagtgactcttgcaggcagtcagacgagggccagtgagaaacaggtctggggcgacgatgtccccaggtggaggggtctgtgtgaaaaaatggggaggagccccacagcaccccttgaagaggctgaggaccttgcttactcacttagtccttgtgtcttgaacacctgtatgccaggtgtaagatggggcactgggattcggctgtgaatgtctctgtctggttggagtttgcattcttgtgggaagtaggcagtgaataaaaatacacataaatagttcatgtgtcagatgctgcagatcccacagagaggcccagcagggagagggagccagcgaagggagggggaggggagcttgtagggtgggggattcttttttattttttaaggggaggtgtcactgtgtggcccaggctggagtgcagtggctattcacaggtgcaatcactatgctctacagcctggaacttcctgactctagtgagcctcctgcctcagcctcctgagtagctagaactgtagtttctcaccaccacccttccctgctgggttggggattttattttgggtgatcagggaaatcttggctgaaaggatcatatctgagctaagacctaactgaggcaagctatgctgaatccgaggaatgaacattttcagcaaagagaacagtacatgcaaaggccctgaggtggaggatgccttagaaggaggccaagtggagatgagtgagtgtggtagagaggagcctgcaggagctgccaggtggaccatatcgcgaagagcctggccagccatcagccctctgtggctttgactcagagggaggtggagggttttgcacaaagtaatatgatcttactattttttacaaacaatattttattatgtaagattttaaacgcttataatagtaacggctaaaaaggtatatacaataaactcaatggcccaacttcaacaattatcaatacatggccaattctgtttcatctgtatgcccacctaccactccccatattatttatttgtttactcattttaagtaaacttttatagcttttttttttttttgagacagggtctcattctgtcccccaggctagagtgcagtggcacaatcatagctcattgtagcctcgaactcctgggctcaagcaatcctcccgcctcagcctcccaaggataattttttgtaagtataacatgcatagacaaaaatcataaagttgtgctccatgaattttcaataagaatacacccattcagtgagaatattaatagctctctgcacctggattttcactgtagaaaggtttttaatgacaggttcattttctttaatatataggaccatgtagattatttgcttcttcctatgtaacttttgcaaattgtgttttttatggattttgcccattttctctaaattttcagattttctgacatcctcatattgttgtttataacatcttttatattatcccgcagatgtttgtagaatctgtagctatgtcccacttggattctgatattggggacctctgtgtttttcactctctttttttgatcagtcttgttagggttttgtcagttttataattttttttaaagaaacaacttttgactttgttcagctttctctgttgtactttctatttcatgaatctctgctcttagtttcattgtgtttgtagctctcctttgggggagtattaactgtctttctctcattccttccttcttcctttttagtttctgaagttggagggtaggttcattggttttcagctttcgttcctactctatggacttaaagctatatatctgcttgttaagcactgctttactctctctctcacaattggtgtttttttctcactatcattttgctcaagagacttttaaatttccattttgacttctcttttggcccatgacttatttggaaggacattgcttagttccaaatattaggggattttctagctaccctcctgctgctgagttccaatttaatcacacatcaggcagagattttctgaaatctgttgatacattctttatggcccaaaatatgttctgttttgataaatgccccatatgcccttgaaaaagagtgaatattctgtatatttcagttaagtcaggttggttaatcaaagccaaatcttctatattgttaattaattggatctcatattctatcagttcctgagagaggtgtctgaaaatctccagtatggtcccaaactggaaacaacccaaaagtggctgactggataaactaactgtgtgtggtgtatccatacaatggacaactactcagcagtaaaaaggagcaagccattattcaatacaacaacttgaataactctcagatgcgttaagtgaaataagtcagacttcaaatgatccattggactttttttttttttttttttgagacagagtcttgcactgtctcccaggctggaggacagtggtgcaatcttagctcactgcaacctccacctcccgggtttaagtgattctcctgcctcagcctcccgagtagctgggattgcaggctcctgccacgacacctggctaattttttgtatatctagtagagatggggtttcactatcttgaccaggctggtcttgaactcctgacctcgtgattcacctgcctcagcctcccaaagtgctgggattacaggcatgagccacgacccccagcccactgaacttttatatgacattctagaaaggcaaaactgtggagatagagaacagctcagtggctgcgaggaacaagtagtaggggaaagtgttggctagagccttgggaaatgtttaggcaccatgaagagtgtccctgtatcttgatttgtagtggcagtcacatgactatgcatttgtcaagacttaaagtagctgcacagcaacaagagtgaattttactgtatgtaaattgaaaactaattttttttttgagatggagtctcgctctattgcccaggctggggtgcagtggtgcaatctcggctcactgcaacctccgcctcctgggttcaagtgattctcatgcctcaacctccctagcagctgggattacaggtgcgagccaccacacccagctaattttttgtatttttagtagagatggggtttcaccatgttgcccaggctggtctcaaactcctgacctcaagtgatccacccaccttggcctcccaaaatgctgggattacaggcgtgagccaccatgcccagccaaaaaataatttttaacctccaatataattagggggcttttgtgaatactttctcatcgcttttcattcaggtgttgcctatgagtttttggttttcaacctccttttaccacctctgtttttacctggcaggcactcttctgcaggatggtgttctggccaccagattcagggaaaggggggatgggaggcacatctccaaggatatctgcatagcaggacgcagcagtactttgagtgttgcttcctttggggctttgaggtagaggaacttctgctggctatggaagctaaaacctgtacatcaatgacacttcagacacccactgtttactgtgacacagatattgtcctgcccaaaatgtgctcccccttcaagatctctccaaggtagacccatcaccacatggcactggttggcagcatggatcattgactgtaccaggtcctctagatcgctgagcccccacagaccagctcttcccaggatttcagctttccccctcctgattccacatgccagttcattcagctttgtttccacagaatggattttcagttattccataccaataccctacatttccctgttccttttaccttcatgtctcccacctggcagaattcctgtgacagaggaatccaactctgccttctccaggtctcccattaggttttcagcactgtagagcagtggtccccaactttttggcaccaaggaccagtttcatggaaggcaatttttccagacagggcagtgtgtggcaggggagttggtttggggggtggtttcaggatgaaatctttccaactcagatcatcaggcatgagattctcataagaagcacacaaccttgatcactcacatgtgaaactcacaatagggcttacactcctatgagaatctaatgtccccactgatctgccagggggcagagctcaggcgggaatgctcccttgcctgcccgctcacctcccactgtgcgaccccattcctaagagaccacagaccagtgccagtctgtggccttggggtggggggactcctgctgtagaggatatcatagggtcctgctattatgccaaattcacgataaattcttctgtggaacagagaactcaacactactctgtcatcctgctatgttcctgtctctctctttttttttttaattgtgaaatatgtcctacatactgaagaactgtgaaatgtagatgtgcagtctcaggagcaaacccatgactggggtgaagcagtggggcacaagccctccccaccacctcctcccagaggtaaccactatcccgatgtttatttccctaaccccttaaacttccacccctagataggtatgccgggttttgaacttttgggaatggtttcaaactctttctactgtcacttgtttgtgtcatcaatattatgtttgtgaaatccacccatgttgatgggtgtagctcttgttcatttatgccaactattgtttggtactcaatggaaatacagcacctccccctgcccctacatgcagggtttcactttccgtgttttagtcactggcagtcaactggagcctaaagataggtgagtataatacagttaagatattttgagagagggagaccacattcacgtaatttctattatggtatattgttataattgttctgtttattattggtgattgttgttaatctcttactatgtctcatttataaattaaaatttatcatagatgtatatgtataggaaaaaatagtatatataggctttggtactatttgcaatttcatgcatctgctgggggtcttggaggggacagctaaggagagactactgtattctgtagtatcccaccatcaaaaaagttgtatatgaggtaatgcatatgttaaccaccttgatttcaccatttcacaatgtatacatattttaatataacacattgtacactataaatacatacaacgcttatttgtccatttaaacaactaattaacttttaaaggcacactgtaatacatttatccaatctactgctaatagacatttggggcattgacatatttttgctattatgaacaaagctgttatgaatattcatccattcactgaacaaatgtttcttgagtacctactgtgaactggccactattttaggcatggggatacagcagtgatcaagacagacgaaaattccttcccacaggggtattctagaggtggctgactacaatgagcaggaaaaaacagggaaattgtgttttatgttagagggtggtaagcactcactgggaatgaaaaacagagaaggtgaaaagtaccagggtagaggctacacagccctgagttgatatgtaggtggagacttggggtgaggacagtgctgtgcagctgtccagtgatagctccagcagagggaggggcctgtgcaagggggcggtgggtgggtccacactgagaccagtggagaagggcctgggcaatgcagggcagcctgactccccaggccgaggccagacctcacaggttaagagtgccctcactgaaagacacaccacaaatttggaggccccaggccacctgcacttttgaccaactgggtacaaatttagcgggtccccctcaagtggaattcactggaacacgctcggaactcaggcagcgctctgctcatgacgacagcttcaccatagcagaaagggccgagtcaggaccagccacaagaagagtctcaaaaaaatgaagaagtcttgaaggacgaggtctgggagggtcccagatgcaaagcttccatggcctctcccagggagtcaaggacatcaccatcctgacacatccgtgggtaaaaacatgcaaaaggcattgccgatgagagaggttcacctcagcttgtgtgtctagagttgggtttctgcgtccagggcttcattgcacaggcatgactgagccaccagcaccacgtgctttgcgctgcagctcctcttcccagaagttgggatgatagcatgtggctccaaggcccaccctctaatcacggggttggtctttcaggcctgaccagccccactctgagccatcttggcataaattcagatgtggtctgaggtgcccaccaggaataacaaagacattcctgtcactggggaaattccaaggatttagaggctcccttccagaaaccaggacaaaagctgtcccaattcctcattccagagcagcctgtgtggctggagaagagtaagtgtggccaagaataaaaggaggcaagatcagagggttatgaggaatagacccagggagtactgggtacctgtctcctggtgcccaggtgcaagagttccccaaacgtaggctggaatttgcaactcctgggttgtacgcaatacacatgttcaactcttgggaaatgtcccattgttttctatagaataacgaccccccaaatgtctgtgtctgaatccctggaatctatgagtatgtttctttacatgatagcagggacattatagatgtgattagtggaggatcttgagattattcagatgggtcatctcatctcaagggtccttacgagagggatacaaaggggtttgagtcatggaaggagacgtgatgacagaagcagaggccagaaagagtgagactgggcacagtggctcacacctgtaatcccagcactttgggaggccaaggtgggcatatcgcttgtggaagttcaagaccagcctgggcaacatagtgagaccctgtctctacaaaaaaatacaaaacttagctgggcttggtggtgtgcccctgtggtcccagctactccagaggctgaggtgggaggatcactagagctggggaggttgaggctttagtgagccatgattgcatcactgtactccagcctgggtgacagagcaagaccctgtctcaaaaaataaaagaagaaagagagaaaaagtttgaagatgctccactgctggctttgaggatggaggaaaggactaaagccaaggaatgcctgcagcctgtggaaggtagaagagccacagagacagcttcccctccagcctccagaagcaaccagccctgctgacaccttggttttgtcccagtgagactgattttggacttctgacctctagaagcataagattgtgggtttttgttgtttaagccacaagatcgtggtaattcgttacagcggtaggaaactaatacacaatctttgcccacccctctaagtgatgacttccctactttggccagcctgttgattaaattgtgttgtctcattgtggatttcatttttactttcctgatgatgaatgatattaagcatctttgcagatatctattaatcgtttgggtttacgctttagcaaagtgcctgctcaagatttttgctcaggttttttcccccatggtttttagcatgtatacagaattgtgtagccatcacaacagtcaattttagaacaattctatcaccccaagaggaaaccccaaaccatctagctgcttttcccacccttccaccccctcccagtcctttgcaaccattgatctactttgtctttatagatttgcctattctagacagctcatgtaaataagaaccatataacatgtggccttttgtgtctggcttctttcatcttgtataatgatgattttcactgtttttaaactgacaaatttaagttgtatacatgtattgtgtacaacatattgttttgcagtatatgtgtattgtggaatggctaaatgaaactaattgacaggcactacctcacatacatgtcatttttgtgtaatgagaacacttaaaatctactgtcttagcaattttcttttttgtttgtttaatatttattttttatttttatttttatttttttttgagatggagtcttgctctgttaccccggctgaagtgcagtggcacgatctcggctcactgcaaactcggcctcccgggttcacgccattctcctgcctcagcctcccgagtagctgggattacaggcacccaccaccaagcctggctaatttttttttatttttagtagagacggggcttcactgtcttagccaggatggtctcaatctcctgaccttgtgatccgcccgccttggcctcccaaagtgctgggattacaggcatgagccactgcgcctggcctatttatttatttttacagacaccttcttattatgttgcccaaggctggtctctaatgactgagttcaagtgatcctcctccctcagcctccccagtagtctcttagcaactttcaagaatcaatacatggttatcaactatagtcatcatgttatacaatagatctcctgaacttattcctcctgtcgaactgaaattttgcatcctttgaccaacatctccccagccccacccacccccagaccctggcgaccactgttctactccctgctcctatgagatcaacctttttagattccacatatgagtgagatcatgcagcttcatccgcctgtcactggcttagtttacttactataagtcttccactttcatccatattgtccaaatgaaggatttccttcttttctaaggctgaatagtattctgttgtgtataggtgccacattttctttatcaattcatctgttgatggacacttagtttgcttccacatcttggctctgtaaatagtgctgaaaataacatgggtgcagacacctcctcagcacactgatttcattccctttggatatatacaaggtagtgggattgctggatctttgctcagttttctattgtttattcttctcattgatttgaaagatttctatatattctaggtgctagtacaatgagagttaaatgtgttaaaaatatcttctccccctttgtagcttatgttttactctctttgtgctgtctttcgatgcaagaatgtcttaacttgtgtaataaagtcccccgtgcgactctcttcctttatggcatgagcttgtcagcctcctcttctctaaattctcaaaacattcccaacaatttcaaatcctccagccttctcccagccttctctctattcccctgcctgtcaaagaatgactctccctcttttacatcctagggaaatttgaaaccactgttaggaaccgtctcaactcttacccccaagtttatacacttacctgcatacctcccttcttccttcccatcataaagttgcacatggtctctttttttctctataggtcaccctctctccctctgccctgggtaccatccccaccaccccatcctctttaatattgtgccattaaatatatctttctaggagagggaaaactatttttcctctacccttttaggttctcagctggggcccctattacaaaaggcagattgacaagagaaaaacagacagaggccgattaacatgtacatctcatatatacattggagatatatatatacatatatgcattgtatagatatatacacttattgtgtgtttgtgtatatatatatacacacacacacacacacacacttatatacattggagaaactcagggatgagtaaactcacagaggtggctagaacttgggcttaaataccatcttcagctaaaacaaaggaagaagggtgtcagggaggctagttatagggatgtgaccagtaaaagcacagtagcaagcgtaaggtttggtatgcaaatttaattcagtgcctcctccattgataagagtctcttatgatttagagccatccttttcttactggtatagagagagacacccttacaaattgacactttttaaaaataaatgtcccttataaaggggtaattattttattatttatttatttattgagatatggtctggctctattgcccaggctggagttcagtggcatgatctcagttcactgcaacctctgcttcccctgttcaagtgattctcccatctcagcctccggagtagctcagattacaggagtaatccaccacacctggccaggattgtgacattttccataaaggccaatatatacatacagcaatttgactggttacagcttgctgcatgccaaggaagattgcttgaatattctgtgaggaggggtgatgatctgcaggggtctcatctctggcgcagcaaagcctttcctaatcacttacaagaagaagcagaagttgcagctgcaggctatgtgactcaggctgcatagccacattcctctcaaggctcagaataatttaaagttccaacagctttaagtttgaattattttacttcacacaccccaaaatatgcttctttggcatgaggatttctttgagctcattaccttgagaaacagcaagctcaagagaagctctaaaagcagaatataaagtacccctttagagccaggaatggtggctcatgcctgtaatcccaacactttggaggctgaggcaggtggatcacctgaggtcaggagttcgagaccagcctggccaacatggtgaaacccccatctctactaaaaatacaaaaattaaccagctgtggtgacatgtgactgtaatcccagctacttgggaggctgaggcacgagactcgcttgaacccaagaggcggaggctgcagtgagctgagatcataccactgcattccagcctgggtgacagagtgagaccctgtctcaaaaaaaaaaaaaaaaaaaaaaaaggaagaaagaaagaaaagaagagcatcagaaaatgaataaatgaaggtaaaataaaaactggaggtaaatgaaggtaaaataaaaagtgaaacgatgtgtgttattattttgtgtatgtgtttgtagcaacttcaattaccacttctgtttccatgcttgtgtttatccataaaataaaaggatgaaaaaatgttaaaaaaaaaaaaaaagtgaaacgaatgacagcaatgatacaagggatgggggaaaaattaggactattttattttattttattttatttattttgagatggagtctcgctctgtcgcccaggctggagtgcagtggcacgatctcggctcactgcaagctctgccacccgggttcacaccattctcctgcctcagcctcccgagtagctgggactacaggcgcccgccaccaagtcccactaattttttgtatttttagtagagacagggtttcaccgtgttagccaggatggtctcgatctcctgacctcgtgatctgcccacctcggcctcccaaagtgctgggattacaggcgtaagccaccgcgcccagccaggactattttatttttataaggtacttgaactccccatgaaatgatgtagcatttttgttttgttttgttttgttctgttttgtttgagatagggtctcactctgctgcccaggctggagggcagtggcacaatcatggctcacttcagccaccatgcccagctggctaattttttattttttgtagagatgagatctcactatgttgcccagactggtctcaaacttctgggctcaaaaatcctcctgccttggcctcccaaagtgctgggattacaggcatgagccactgcacctggctaatacagtattatttgaaagtggtcttggactagctgtaaatatttagtgcaaactctagggcaaccactaaaaaaatgtttaaaaaaagaagtataactgatatactaagtatacttatcagcataactgatatactaagaaaagagagaaaatacattgctcaattaaaaccacaaaaggcagaaaaagtgtagtaggcaaaagtaggaaaaaaggacaaggacaatgtatagaaaacagcagcaagtatggtagatattaatccaactatatcaatagttacttgaaatgtcaatggtctaaatactaactaaaagagactgtcggagtaaatcaaaaaacaatactcaactatatgttgtctataaaaaatttacttcaaatataaaaacacatatagattaaaagagatggagaaagacataccatgctggcactcatcaaaagaaagaaggagtcgctaaattaattaatttttttttttgagacagagtctcactctgttgccaggctggagtgcagtggcgtgatcttggctcactacaacctccgcctccctggttcaagcaattctcctgcatcagcctcccaagtagctgggactacaggcgcatgccaccacaccacgctaatttttgtatttttagtagagatggggtttcactatgttggccatgatggtcttgatctcttggcctcgtgatccacctgcctcagcctcccaaagtgctgggattacaggcgcaagccaccttgcccggccaaaatggaccaatttcttgaaagacgcaatttaacaaaaaccacacaagaagaaataaacaatctgaataggcctatatttactacagaaattgaatctgtaattaacgaccatccaaatcagaaagtaccaggtttagatgggtttcctggtgaattctaccaaacatttaagcaagaaattatatagtctctttcacaagatagaagcagaaggaacatttcctagctcattctatgaggccagagttaccctaataccaaaatcagacaaagacattacaaaaaaaagattcaactatttaagaaaatataatctatacatacccttagctgggttcatggaaactacaataagtgcaaaattctgaaagcaagaaacatgtgggggaccactgctctctctctgcagtggggtctcctgctctgatccagtgggtggcctttaccagaaaaaaacagaatccacctgacattggatcaaggcaggtgccggggtcagtctgcaaattagttattagtaaagctgaatttctgtattttaaataaatagatataaatggatcatcctgcttacccaacactggaaaccgctgctatatttgggaacaaatagtcaccaaataccagcccagtgctgagtttgtaacatgaattactttatttaattatcacaactatatgaagtggattctaagataccacccatttatgaatgaaactggtggctgggcgcggtgggtcatacctgtaatcccagcactttgggaggccgaggcgagcagatcactgaggtcaggagttcaagaccaacctggccaacgtggtgaaaccctctctctactaaaaatacaacacaggcatggtagcgggagcctgtaatcacagctactcgggaggctgaggcaagaaatcacttgaaccgaggaggtgcaggttgcagtgagcagagattacacaactgcactccagcctaggtaacagagcaagactccatctcaaaaatatatatatatatagatatatgcagatatagatatcatggcagccatagctggggcagcatccccgttctttgcttagtgcagtcactcttcttattggacataaatcaagtgcgaccttatgccccaccttctcagtgacccaaggctccagtcccttctcagagggagggtaaaatccagagatgccccagccgtcttgcctctagttcttggatcttcacaataagcgatggtcatggggctctgccagtagttgggtcaggatttctttctatttggtgttgtcccatccttttctggaagaatatcttgaatatccaagtttctgatttgtcaatgtcacacccctccaatttctggcatcgatgcacgctttttctatttctgtgttctgttcttggctatttcaatggaaatttggaaataacttagaggtgcatgcaaatgtagccattttatctggaagtctcttgcatcaagtacaaaagctaaatgttctttttgcctctagaatgtgatcatgggcaaattttctgaactgaggcattatttgtctcatctgggctaatggcttgtacctgaaactattgtctagagtgtatttctgtcaaattagtggaggcaggaggagctggaaggtagaggaaggcaggatcttcaaatgttcccaggatgcacttttcagttcaccccacccggacctattcaaaggctgctgtttacaaggctctttctagggttaaggttttcagtgtgagctctgtgagcccctgaggagtgggaagagactgagtatgagactccagcatcccccattttttccacttcacccaagcagcttcgtgagaagatctatgctaggaacatggtccaaatcctggttggacatttacagatgatgtaagcaggaccgagccaggggcaccattccagagtgggaagggagcaggggctcctgggtttcagtcctcgacctaagtcaggaattcctgagccaggagccaggaagtcctatcagacctggaaggaccctgtcacaagaggtggtggggagtcctgtcctctctgtacctgagggtaaggtacactttgcctccttaaggagatccaatgtctctcatttcacagaagaaatggggatgtttctattacatggaaagtgaaagacagcaacatcaaagcaacacttatttagggctatgggcaagactgatgtctctccaccctggagagcttccgcctctgaagtgcggaatgcgccccagcagcagctctgcaaggaacgagtccacatagggctctcagcacccgcttctgaggctgaggacagccaggcagtgtcagacatctgctgtcgttaaggctcaggatcctgcaactctgcagcctaatccagctttctgcgaaagttggaacctctctctgtctgagggtccttggctgccggccacaaagacgtgcgctgttggtcagcaccgaggacagcacttgggggcggtgctccggggaattcctgggtgacgaataccaggacagaaggaccttcttcccgacagcaggaaggatcaggctgagggtagtagtgtgcccgggtagtagtgtgcccaggtaccctgcaaatgtcataggcagctgacgagccccttctcgtcatcagccagggttaggattatctaactgcaccctaggggctaagaggccaaagacatgagtggaagccaagggagggttggggggccagatgacctccctggacagagagatgctatatgttccccagaatggcaagccctgcccaaccagcacagaccagctctgtggctctacctcccggcccaggacacaccttctctctctggcctgcctgctcacactcttgaccttggggtgctgtgctttccaagggcccttggtgtggaatggaaatgcctttactcatccacctttagtggagaaatcgtgagagcagcaggggccaatgcaagagagagaaggccccactgggatgaggctgcccagtcctgccgcaggtgccagcacggctgctgcactggggtagagctccattcaaagcgaagctctctgttcccagcgttatcgagtggtgggacactgttccctctttgcccctcgaagggctgccctctgctgaccacttcctgtcccccacccactaatcctttccctgcatcctctctgatcctcacagcaccctgtggggtgggtgctactgttgttcccattttgcaggcaggaaagacagagaggacaagcgacagtgagtggtggagctgggactctaacccagctctgtttgctgctagcatccttgtgttgtgctgcatggctccaagggttctgtggtaaggttcacaccacagctgagctccagggccttcctttctaggtagccagaggccatttagatttggagctgggcacagtggctcacgcctgtaatcccagcactttgggaggccgaggcgggtggatcacctgaggtcaggagtttgagaccagcctggccaatatggtgaaaccccgtctctacagaaaatacaaaaattagtcgggcatggtggtgcgcgactgtagtcccagctacttgggaggctgaggcaggacaatcacttgaacccaggaggtggaggttgcagtgagccaagatcacgccactgcactccagcctgggtgacagagtgagactccatctcaaaaacaaaacaaaacaaaacaaaaaatagatttggaggtcagacccaaatggccatgctcggtgctaggcttacaaggttcctgtgccctgaagctgagagtccctggaggaaggcccgtattaatgctcacatactcacacaaggccagcccctcctagcctccagtgtctcacctggtctgtgaagggcatgactgacagtcgtgcctctcccatagccctgtccagggtactgagcaaggatcccactgagaagtatctggtccaaggtacatacttcagaaacatgacctcctttctggctacatgttggagacccaggaactcagcctggttttttggacactgagtcaccagcaggtctccagccaggggctgtgaaggttgagcatgggggcctccctggccacatggggctggcatcccaaactaaaaggtgagggggtccaggggcacatgaaccagaggcagagagagatgggggtgctgtgagctaacttcagtcctagcactgccacttaactgtctgtgtgaactgggccaagtcccttgtgcacctcagaagcagtttccatgtcagtaacaggggagtaaactgagggcacctctttggataaaggaggagggaacaccagggaagtgcctggcaatggcaacagagcacacgaacacatgcacacacgtgcatgcacagcccccccccccaaaaaaaatactcttaattagcccagcagtgcgagccctcacagactgggttttgaatggtaaaaatagtggtctgagagtggtgagcccctggaggctaacggcattcctcaggaggtacagtctgtgtccctctcgtatggggcacattgagcctccttaagacagtgcggatggtgagtccctgaagaggaacatggggccctgtggaccctgccatctgcttccctcatctcctgggcccaaactggcactggtcaggagagtctgtggggactcccttctcatctcccctctttccctcctcctctctcttctagaaagaagacagagggaagaggatgcactgccttcctgctaatggagggggaggcttgggcactctcttctttctagaggttgatgcgtttgtcagaatccaacttctgtccctgctcacagattaaatcactcatttctaattgggatggaaagctcctgcatgggtgccactgtgaatggcattgtttttcaactaaacggatcataactgatcaggaagggttctccacacttccagtgcttcccggaagcagccagtggatgccaggttgcgggggaggcttaaagcaaaggcccctagagaagccgcaagagggtttccagggccaggtcagaccgtgttaccataccccatgcacatgcggtgtgcagcacagggcaggctctcagcacacacttgctgaacaaatgaggggggtgaattaatgaatggagggaggaagcaggagcggacatgggaaatgcagagaagactcacattagtttagccaggcaagatgaccctcaggtcccagaacacgctcctcactggggaggacaggcagccatttcgcagaagagacagcctgaggggttgggaggctggctgcagcccatggcagggacaggccagagcccagccttctgcctgggcttggatgggtcattgtcaggcccccagccattctgccaagagaactggggttgggggaggcttcctatggtgaccccaggaaaggagccacagctggccctgggggtggcccctaaacccctgcctgggctaagggatgggagagtaagcttctgcctcatcccagggcagagggtggctttgctcagggagcatcctgcagctgggctactgctcctaattttcacgccttgtgtgaccccaccctcgccagccctccttgagggcagtggggcagctgagcctctcccccatgctctggggctggtttggtggaggggaccacaccaaggggctgtggatgctgaagcgaactcccaactctacttgcagcatagctgacaccgcgtgatgaagccaagagcgcaaactgaggcctggtcaagctggggagagggcacaggagacagaaaaggattctttcagagggagtgggagcgggacagggaaagaggaaacagaagcggatgtggagaaagaataatcccgccccaccgaggactgtggggtgctatgggctgctccacagggtgcatgtctgtgcacgtgtctgcgagggcacctgtcggtgtctggcgtgtgtacccagagtgcaaaggtggcatactcaggcgcactcgggcaccccctgcaagacagcagagcttgttggaatctctggaacccagagcggggaggtgcttggccttctttgctccggtgagtccccacagaccctacaggcctgtggcacaggcactgaccaaccaggccacagggagttgatgagaccctgtgacacctgaatgcacctcagtgcacaggtgcctcccaagcatgccctgtgttcattcccatgttggcctttcagagaggaatgttctacccattttacagaggacagggggagaccagtgagatcagttttctagtcccgtattgccacaaatgggaggctgagccaggaggatcccttgagcccagaggttcgaaaccagcctgggcaacatagggagactctgtctctacaaaaaattaaaaagtagcctggtgtgatggtgcatacctgtagtcccagctacacaggaaactgagacaggaggatcacttgagctcggggagtcgaggctgtagtgagctgtgttcacaccactgcacttcagcctgggtgacagagcgagaccctgtctccaaacaaaaacagtaacaacgaaaagagactcctgggctgtgctgcaggctctgggaggaagcagcagaggggcctgggctccgagggctttgagaccctggagaggacctgggagtcaacacctgtcctcctccttcacttgctccaggacagggtggaagtgtaggcatttgggcttcagaggccaggcggagtctggagcaaccccaggcagcagagtggccccactccaggaaactcctccaggtgagcccacaactgaccacaaggcttgccctgcccccatgtgccttgggcagaagaaacagaacagtcacaccggtaaacaggaagtggaagggcgaggaggagcccagtcgtgagtcactgtaatttaaacacccaaggcagacaagtagcacaaaagaggaaaccaacacatctcatggaaaacacattcagggacccagagctaatacaacaaacagaataagactttagaataagtataattaatatccacagagagatgtgcgtaaataggaagccagaacatattccactgcaaatcttgacagcatccagattggaaaggaagaggtaaaactctctgtttgcagatgatgaaatcttgaatataaaaagtactaaggaacacacacacacacacacactcacagctaatagcaagttcagcaaggctgtaaggtgcaaggtgaatatgcaaaaatcggtcatattctatacactagcaatgaacaaactgaaaatcaaattaagaaaacaatataatttggagggacaccataacaaaatgccaccaattgggtagcttatgggtagcttacaaatatattgtctcatagctctggaggccagaggtccaaaaccaaggtgatgcagggttggttccctcacagaaggccgtaggggaaagctctgtcccaagcctctatccttatttctgatagctccttggcttgcggcagcaaaaccccaggctccacatgcagttctccctgtgtgcctgagcctgtgtctgtgtccaaatttcccttttaataaggacaccagttacattggattagggcccaccttgttccagggtgacctcattctaagtcaattatttgcatctgtagttaccctatttccgaatagggtcacattctaaagtactaggaagtgagacttcagcatatgaattttggggagatatagttcaacccataacaaattctgttcacaagggcatcagaaagaataaaatattgaccgggcactgtgactcccagcactttgggaggccaaggcaggaggatggcttgaggccaggagtttgagaccagcctgggcaatatagcaagactctatctctacaaaaaatatatacataattagcttctcaggaggctgaagcaggaggctcacttaagcccaggaggttaaggctgcagtgatccgtgttggcaccactgcactccagcctgggcaacacagaaagaccctgtctcaaaaaaattaaaagactgaaaatttatgaataaatttaacaaaagaagtgcaaaacttgtacactgaaaactataaacacagttgggagaaattaaagaacacttaaataaatggaaagacatccacattcatggattgggagacttaatatggttaagacggcaatacttcttaaagatctctgggttcacagaatccatatcagaatcccaggtgaattctctgcagaaagttacaagctgttctgaaaattcatatgaaaattcaaggaacccaggatagttaaaaaaatcttcaaaaagaagaacaaagttggatgactcacaattcctgatttgaaaacttactacaaagctacaataatcaccaggtgtagtggctcacagctacaatcccagcactttgggaggccgaggcaggaggatcacttgagtccaggagttcaagaccagcctggtcaacatagggagaccctgtcactaaaactaatttaaaaagtagccaagtgtggtggtgtgcacctgtggtcccagccacttggtaggctgaagaaggaggatcgcctcagccagggaggtcgaagctgcagtgagctgtaatccagtgccactgcactccagcctgagtgacagagcaagaccctgtctcaaaaaaataaataaaataaaataaaataacttttaaaagaacaccaaaacaagccaggcttggtagtacatgaccatagtcccaactacacagcaggctgaggcaggaagatcacttgagcccaggagttggaggagtcgtatgcaatgatcacacgtgtgacaatagccactgcactccagcctagacaacacagagagaccttgtctaaaacaaacaaacaaacaaaacccaaatagaaattaccaaccacttagaaatgggtgacagaacagaatattccactttttaaacttgtgaaatgtttcaaagcaatatccacagaaaatgtagaagccttaatacgtttattagagaaaaggaagattaaaaataaatgaactactatcttagttcaaaaacaggaacactaacattaaaataacccaataaagttgaataaagtgattgatagagaaaaaagcaaggctgagtgcggtggcttatgcctggaatccccctacccctcacctgtgaggaggtggatggatcacttgagcccaggagtttgagaccaacctggacaacatagtgaagccctgtctctactaaaatacaaaaattagccagtcgtggtggcgggcgcctctaatacccgctatttgggaggctgaggtgggagaatggcttgaacctaggaagcagaagctgcagtgagccaagatcgtgccaccgcacttcagcttgggcaacagaccaagaccctacctcaaaaaacaaacaaacaaacaaacaaacaaacaaaaaaacaaaaatgaaaaaacagagaaaaaagtagaaagtcatgaaatagaaataaatgggaaaattagaaattcaataggaaaaaaactcaccctcagaatggagtgatgctgtgagtttcgatggaagcaggtgaggctcaggggtttgcatgagcgttcccaacctgggtagtgcaacttgggcagacggtcaggagaagagagaaaacacagacagatgatgtggggaaagatgaagtgggtgaaggaaattagtcttcgtggcccaatatgtatgaggaaagctttgaaatcataggcatcatggaaaaatgtatggaaaaaatacaaattatcaaaatgagtgagaaaaccccagtagacttaagaactacagggaaggaaatgaacaagagaacacaaggtttatcgtaaaatgcagtgtcattttttcaggcaatgtgactttctacactgtctagaaaattgaactaacaaactataagaataattaggacaaattcaactatgtggcaagatctacacaaagccctcctagctatcagcaatgatgaattataacatagaaaagaaaaatgtcattcatgatagcaacactgttacagcacatagaggggaagcccaacaaaaaatgagcagtaccaatgtggagaagactataaagtgtagcatgtattgcacgaatagagatatactgtgttcctcaatggaagattgaacatggtacaaatgtcagttttcccctaaattagtgtagaatttaaatttggcatcaattacaatcaaacaggatttccgctataaaactgacaagccaattagaaatagaaaatgtacaaaaaaagacaagtgtgaaaaagagaagaatgcagcagagattctctgtgatacacaaaatatgcaataaatgattttaattgaaacaatatataaaaataaacatatagccagcctggacaacattggaagaccccatctcagcctaaaataataacaataatagaaatcatctaggtgtggtggtgtgcacacctgtagtctgagctactcaggaggctgagacaggtggatcgtttgagcccaggattttgaggctacagtaagctatgatcacgccaccacactccagcctgggcaacagagtgagaccacctctaaaaaaatttaaaaaaataataataaataacattttaaaaaagaataaatatataaaatactcactttaaaaaagaacagtgtcctgaaataggcccatgcatttagtaacttcctataaactaaaagaatgtgaaaatataggctattcaaaaaatggttctgggttgactcactatatttgtaacataagatagagagctatctcacaacactcaaacaatccagatgatgtattaatctaaaccattgtaagaaaattataaaaccttcaactcataaaaaaagaaaattataaaacttaaagaaaatatgcaaaaatataagtgaagaaaatataaaaggatatatattgaggtagaaaagtcatttcttttttgagatggagtcttgctctgtcgcccaagctggagtccagtggcgcaatctcagctcactgaaacctcccgctcccgggtgcaagcgattctcctgcctcagcctctcgagtagctgggactacaggtgtatgccaccacccccggctaatttttgcatttttagtagagacagggtttcactacgttggccaggctggtctcgaactcctgacctcaagtgatccacccaccttggtttcccaaactgctggaattacaggcgtgaaccaccacacctggccagcagaaaagtcattcttaagacatgaattataaaagctacaaatgaaagattaatacatttgaccacatcaaatttaaaacaaaaatgttctatagaataaaagacactaggcaaagcaggatagctcacacctgtaatcccagcatttagggaagttgaggcaggcagattgtttgagtccaggagttcaagatcagcctgggcaatataccatctctacaaaaactagcaaaaaatagctgggcatagtggcatgtgactatagtcccagctactcaggaggctaaggtgagaagatagattgagcccaggaggttgaggcagcagcgaactatgatggcaccactgcactccagcctggatgacagagagagtccctgtctcaaaaacaaacatacaaagacactaattgcaaacctaaaaggcaagttacagtgtagaggaaacattggccacagctataccaggaaaaacaatccctgatacacgattaaggaaaattcaacaactaagtagggagaggacataaacaagcaaatcaaagaagaggaagcacaggcaactgggatccatgaaaacatgcgtaatctcaagacacaagacacatttttcactcgtcagtttggcaaaaactgtgaattatgaaaatgtttaggattggtggggtgtaaataggtgcagcatttctggagggcaattcgtccatagctactaatgtccccagtgtctagcaacatggaaaagtgtaaataaatgatccctattcggcagtttagaaatgaggtcgtcctatatgcattaatatggattacattgctaagtggaaaaagcatgtcacagaagcttgaatccatgggacacttttcatgtcatccatttgtgttaactcacagatgaagctcaaattacacaaaagtgaattaagcagaagccctcaggagggacgtacactggagggttgccctgtcatctccagggagggccccaggcttggtagcggagagcaggtggcctcacgaggactgctactgcatttgaatgatctccctgctttaattgacagaacaggtgtgtgtattgtgcatacaacggattcctgtgctgtcttctcaggtcacagaatcccagggagacataaggaagaggcgaggactcaaatgctctgccaatcattgggagtaacttgtccctagggcagaagaaagagctgccctcttctgtccctaaaaacatgtttctcttccttaataatatcacggggtgggggggagcagggagagagagactgagcaagagggaggcgccggagtccctttctgattctgagacagtaatgcccaggttttgcacaccatgctgtccactttgccagcaggactgggtggcatggcacttctgatagaacgtctgctgtctttctccagattccattctgtgcccttctgcgaggtcgaagctggtgcttccttgatcataccagcaggtgtcagcagaatgttctggacaccatcccagacgctggcttcttcctcgtggtccttcagtggtttgttggaaacactgagggctggggtcgtccagtcaggttccaggtgaaagtgtgcagaatcacctgccgcccgcccagctcctgactctgaagtgctgagagtgaacacagcttcagaacagatgaaaggcactgcttctctcccatcaactccacacacccagtgataacagaaaagggcagtccagtcttctagtcacccttcgatgtgatggggcagctgcaacccaattttagatgctccgagaggttaaatcaattccccagggcacacagccataaacggcaaagacaggacttgaagtcgagactgtggttctgaatagtgccctgtctacactacatgaccaagagggcatttctggagggcttgaggttgcgtgtgtcaacccctgtgaatcgcagggtgaccaggagcaaaaggcttgccacagctgagaccccccagggtcttgctctgggccttcccctccctggaccagagcagccccatctatgaaaagatcatgctgtactctagggtatctgagagcccccgagcaccacggctccatgactaagaaactccagaaaaaaactgtgaagtgcggcttcacttctctgcatctggactcaggatgcgcctcgtccagcctgaggaccctggacttcatgcctggcaaaaggctgtgccactgaggtttcctgaaataacactgcccaattcggggacatgccctacagtcctctggatccagggaacacctgtgagcaacagcctctgggcttggacagccgatcctgcccctcatgtggacggctggcccactcccccaaagtccccgatcctagagggagagacagaaatggggaggtctgggtctgtccagcaaccaggataggcacctccttcttgatcctggagacaggctcagggggtgagcacagaggggacttcccagggtcgagaaactgcttccggtgaggtgagaatggatagatcacctgaggtcctgtggttaccccacccacccgacctgtggtccccctacctcctgtggtgactccaccccttcctgcatccacccagctcctcctgtggacacaccacatcctcctggggacatctcatccgctcctggggacaccttaccccctcctgggatcctctcaccccctcctggggtcatctcaccccctcctggggacatctcaccccctgtggtcacccaccccctcctggggtcacggtctccccaccccctcctagggtcatctcaccccctcctggaaacatttcacccccctgtggtcacccaccccctcctgggaacatctcatctcctctgaacacctcaccccctcctggggtcacccaccccctcctttggccctccttgccactttcactgacctctcaagcccgcagcctctgtgtggtcccctgagcaccccgaatccctgtacctataggtagagctggactccagggcactctggcttcatcccctgctgggctcagccctgagatccccccggaggactgcagcaaccctgagttgctgcttgcctggccccacagctctgtggagccgctcctctcctcctcacagggctctgaggagggacctaaaaggcgagtggacagccagccatggagggtgccacttgctgggagtccctgccatccctcccggctattgggggcctgcctcccctgttgacagcaggctggggatgggatgagctttggcaaggaggtctgagtggccatggcctgggcacccccaggaagagctgaggggccggattttgggctcccttcactcctcacctcccacaagccttgcaggtcccatttgtggcttctgcatcctaaggccccggctgaggggactcgcagtagacggtccatgtgggtaagaaatagtcctctgggtcacagtctctgagatctgggccccttcattacagcagcacgtcttagcctgagtgggctggtgtcagacacagcgagtggcggtaagtgtgggcccctcaccatctccccttcagggatgaagagggccttgtgccagcaaagtgagtaagaaagagcagtccctcaagaggagagcagggaagggcaagggatggccgggccgagggcagtggctgggagccaccgaatggaaaggggcgggcagtggagggggcggtcatgaggctgggagctgtgccagtgtccagcaggccgcacccctccgcctcctctcacccctcacaggaaggtgttaatccatacatccggagacccagagaaaccaagtaacattgcattcctggctgtgtttcttttttattttctgttttggggattttgtttttggagtttttttgagacaggatcttgctctgttacccaggctggagtgcagtgatatgaacatggctcactgcagccttgaaccctggcctcaagcaatcctcttgccctcagcctctcaaatagctaggactacaggagcacatcaatacacccagctaactagtattttgtgtacagctgggtctcactgtgttgcccaggctggtctagatctcctggtgtcaaacaatcctcccacctcagcctcccgaagtgctaagattataggtgtgagccaccacgccaggcctgtgtttcagtgcaaaataatatcattacatatctttcaaatctctccagaatgatgaacttttgcaggtgcctcatttgatgaggtcaaggatcccatcttagatatgcaggcagaggccatgccagctagtacaagcctaaggcatgtagaggtagacggcatggccgagggatcatagactgggtgcactggtcaggagtgggtgaagtaggtagagcctatgggggggagggcgcagccacatagagaagtcctgtgtccccactcctgccccaggctcctccacaggtgtcccagcaatgggcaggttggtaagagtcaggctgggctttttacgaggagaggtagagacatcttcgtggccttaccctggaggagagagaccaccagctggtgagagactgttgtgctggtactgctggggaagcctgcactccacctagcgttaatgagaatagtgtctccttggaggcacagggtaatctcatgggggacaattatctcaacaaacgtgaagcccagccacagagatttgagtggaaggaacacagatttctgctcctgttaatttcatgcttgacttaaccgtccttacgtgattgtggcactggtgacagtgcactggaaacacttcttactcttcttccccagccaaaccttctctttctttgtcccaaagatttgaactcttgcttttgactcaagttccctgtcttagagattcatgggcatcattgtgggaacatgtttattttgcctctcctggctgggtgtggtggctcacacctgtaattccagcactttgggaggctgaggtgggtagatgggttgggcccaggagaagaccagcctgggcaacatggtgaaaccctatttctgcaaaaaatacaaaaaattagttgagtgggtggcacgcacctgtaatcccagccactcggaagactgaggcaggaggattacttgagccaaggaggttgaggctacatacagtgagctgtgatcacgccactgcactccagcctgggcgacagaatgcaatcctgtctcaaaaacaaacaaacaaacaaaaaaaacctataatagtaggtgctcaataaacgtttatgttttaaaaaggaatatcatgatcatccacacttttagaatgatgaaattgaggcttgggagagtaggatgtttgcccaaggccattcagtgcataggtggcagaacaggagtgggaattcagatccctcagaccccaaaagttgaaatctgcctttgcaggtgggaataattccacccctcctcaacagccacattggactgaagatgggagttagggaaagaggcatttggggaggacataagtaagaacttgtcagcaggatgggctacatggttttgaatagactgtgatttaggctgcacattgatctaggagctcttgattgcatttccaaaggtggtcacgtatgctctttccacggtatgacctggatacacctccatcgagaggtggagtccaagtccccaccccttgacctgggtggccctcaataactgccttaactcatagcgtatggcttctgagacacaaggccacacagctttgtcgtgggcctctcttggggcaggcgccttgggatcaactgcaggtgtgaagcctggctgccctgaggccaccatgctggggaggccacatggagactctgccagagatagtgatgcaaacaccctctgaggcgggaggatcacttgaacccagaagttcaagaccagcctgggtaacatagagaaacctcatctctgctaataataaattagttgggcatggtggtatgcgcctgtagtctcagctactggggaggctgagatgggaggatcgcttgagcctgagagacggaggctgcagtgcgccgtgatcaagaccctgtctctaaaaacaaacaaaaaaatcctttaaaatactctctcgactctatttttcttgtgcctctttttgctcccatttccaggaaaatatgctcaaaaattcatctactttcatggtctatactcactcccatcccatcactcttgaatctattccaaatcatttcctcaaccaaaactggtcttgtaaggcttcagtggcctccatgacagccaattcttttttttttttttttgagacggagtttcgctgttttcacctaggctggagtgcagtgttgcaatcttgcctcactgaaacctctgcctcccatattcgagtgattctcttgcctcagcctcccgagtagctggggctacaggcatgcgccactacacctggctaatttttgtatttttagtagagacagggattcaccacgttggccaggctggtctcgaacttctgacctcaggtgatccacccaccttggcctcccaaagtgctgggattacaggcgtgatcccacagcctgtgggattacccagcccacagcagccaattctagaaactaatccttagttttctatgatgacgtagcctatcatgacctatctgtatgggctcacccctgccttcctaagcccctccttcccctatgtcctcctcctccacagcccctcctcggcctcctaacctgtcccaggacacccctgccctgttccctcccctcaaccccctttcctggttcccccacctcccactggcgtgcccaagactcagtcctcggctccgtgcctccctctgcatctacctactctgtgatctgtccctctctggcactgcagacacagtgtgggtgctatcaggtccagactcatacgtccaacctgggcctcgctggctggaaccagaatcccagccacctttgggtgatgatctgtggccgactgccactgctactacttgagactgtcactacaacaattactactgttactgcctaagactgtcattacagtagttactactgttactgcttgagactgtcattacaagacgaacgtagaaatgataaaagacaaaagtaactattttaaggaaaggctagcatggggaagaagaagagagaagagaagaaaagggctctctgcttgtattaagcaaaggcagccgtctgagcttctacagcccttcgtatttattgggtaacaacagcaaggaggaggaggtaatgattggtcagatgcttaattgatcacaggttcatattgttactaacaagcttcaattatgtctaatcataagaaacatttgtgcagcttccaacatctcctcctttttgtttttaaattaattgagcaaggcaattgcaggctgtgcagcccttaattgcgagttggtgatccagcttcatttttcttagcccttattcaaaatggagttgctctggtttgaatgcttcttacatatttcccccttccctttaacaagaggacccttaatcctaagggttgcagaaagatgaaggtctctcttctgcaacttcttcatgctgaacaggggcgaaaatattcttgcctattaggttctcttgtattcagggtagagaggagctcagtcagaaagcattggtccattaaggtacaatcgatggattgtacctctgagttccagcacaaggtaaaaccctggcactccagcagtttctcagcttcctgtgtggttttcttgatctgtccccatgtcacgggggttggtgtcagcgtgactctggttggtcctcgttctgttttcgcattcagattcaactggctcattgctcatactgggggaaccaggcctgtagttggaatccatgggtccctccagtctccctttccatggttgcacacatcttgacggcacccacatggtttgttcatctcctgcaaaaacacaagcataccctcgaccccacattagtaaatctgtaaaagcaaaggtttttgtggctgtagccaggaggcatgccactgctgaagcaattgtaactcagcttctgcctctttagtcaattgccatggggtaaaactttccactgataatgaaagacaggctctttctgattaacagaagacacggaaaaagcaaatcgaggcttatccttctcataaacaatcctcaagatctattaccacaagagaccagtctcttgctcctgtatccataagcccacaaaacttattttcttcaatgtacactgcacaattgggtctatgagatgctatgggttgtgatagataaatttatctcctaattatacctccccaatccctgatctccttacttcttacttagagaagggtacaatttacaggaaataagcaacaactgagcaatacgctctcctggttcaaaaacccaaagatcttgtgacattaccactacctgaatttctccttcacaatcaaaatcaacaactcctggacctctaagttaagatagcttttaccaaaatcagtcccatgtatattgttggcaaaggtccccaaataccaacgggaatcttagtgagtttgtttctttcaattaacataattttttctctaggagagctaatcctgcatttccaggtgttcctgaggagagggaatcaatgtgcctctggaaacccacccctgaaacggagttgtggcctggacggggaatgccctcatagtttgaagtgcctgggtccaggtccccttttcgcttcccgtgccattttgatgaaattttgagtggcattgattagcccaatgatttcctttattgcaacgagggcaaagtcctcatgttttttctgtggagaggggaaccgtgttttaagatcccttctgcccagaggtctggcggtgttcttttttgaaacatccaatttttctacacttgacattgtgtaattgacattgtggacctcccaagtagaaagcaattaagcaccagcggtagaacacaggttagtcttaagaccacgtgattaagcaagttagttagataaactccctacactcctttgtttctaccctaatttatttaactaaaggtaaagggactaggctgccttcagccagatttattaccgaagttatgcaaactctcaggccttccaagagggtttgtggctattataactaaaatttttcccaccagcttgactgaacccccacatctctcccttttttgttttctgcatcaggtcttttgcattggagactgcagatgtgtgcagcaacaggtttgtcgggcatggcagtcattgctcttattccagctttgcatcctagaattagcaaataacataaaacaatcatgagtacaatttgcaacattcagttccagtcagagtgacctccaggagtgggggtctaaccaggagagatgattttgcacacctttccatatggctgtttgttgggtgtgtagatctatggtgtgaggggattctaaaatttttgttttaagttgctttatgtctgctgttaaattgtcatgaaaggttccccagaggtgttgtttcacctcatctcaactatgtatagattgattctatggtagagaagtgacacagatatgtttatgctcccagtcacagtttaattgctgtcggaatgccagtgcatcttgtcgctcccccacgtattctaaagctgccttgtgggcttgcagacgtgcaagaattttttgatctataccttgctgtaagacttcattagacacatttttggccagattatctacaaaggcagctgtttgtactgactcagtaatagatgcgagagcaacgcgagcagttgccaggatgactatggctgagactataaaagccataagtgtaactatgaatcttttgtgtctgacgtgggatagggtacgttctacattctaaggtgacaaggacagaggaaccttgccaatcatgagtcagattgactggtaggaatgcctcagattgtctccttaatatcacgacactagtaatttttaaattagatatattgtggtgatacatgaggcaaaccaagcctgtccctgcacccgggtcacaaacgtggagttttgaggtgtaatggaaatgttagttcccataaggaaaacatatggatgggtagagcaaatcaggcactgatcagtgtgattatgaataaaggttatggtatagttgcgactggatttatgacatgtcccatgccaggtgttaagggaggtgctaagatgtcccaggtgccataagtttcactggggtggcatggactttacttagggtctgggatatctcatccccccatcagcccaaattataggggaacgagacgtggctttgaaactgtgattgatgctgtgatggatgaagacattagtaaggctgccctacaatcggccatgggggcaccagtctaagatgttataattgcctaactggaggctatgggcttgtctcctgtgacagacctcccagctaaagtggaatccattactttcctggctttgttctttagcacaggaaggaatgtttgggaaagcggtgttgattgcattgcccagtttgaggcttcctgcagctaagaatgctaaggcatttccttcacagtgatgtagccatacttgttttggggcaggtacacagtaagggttagagcctttataacttacacacagtgggaggatagtggagtgatatgtaatgttatctggcatcttagtccaatgtgtgccattattgcgggacctcactggcggtaaatctattcctcctaactaagcagtcacgttattataggctgggaagggagcgtctgcccaggtgacagggcaaaagaaaggtgggtctaagatatgagtccaatacagtgtagtagcaggtacaggttgcagacaaagtgagagcataaaaaggattaataccctatatgagatgcaatgtacaacagaaagcatagcaagaaataaattatctggagtaaatggtgtttgtgtctggagcaggattcattcagcctcctgaattgtcctcttcagcatcccccaggtaacatccaggactcacgtcatccgcggaagccacattgtccagggctgtgggtcttgcagggttaactcctttatttctggtaccggattcggtcctagctacaccatggtatggtttgatgcatcatgctggaatccaaagaggacctgagggggtgtggacacaagcataccctcttccccacgttaataattcatttggaccacaccattcattacagttcacatctttccataaaactgctggttttatgccttgagaggttttatcaaagtgcttttctacagctgattgaatgaaatttgtcatctaaatttttaaaattaagggtaaataaggcttgtgccaatagtgttgcagggtctttacccatactcctccttttttgttttttgagcatatttttaacagtggagtgggcacattctactattgcttgtctttggggattatatgggatgcctgtggaatgttggatattccacgtgtgacaaaattgttgaaattgtgaggtggcataagccggaccattatcagtcttaatttttgcgggttgtcttataaatgtaacagttaaaagatgtttaatgacgtatcgagtggactctctaagcagagcatgtgcactaattaaatgagtgttggtatcaatggatacacgcacatatcttagttttttaaatttagggatgtaggtaacatctgtttgctataactgattaggttctagttctctagggttaacacctgttgaaggaggggacatgcctgtgagctggccatctgggcattgtaggataatttgtttagccagtctctgtgtaagttgaaattgtttagataagtttgtccaattttggtggaaaaattgatgtgattgggtggcttggtcaagcagtgatgtcataacctgaaggtctgcttgttcattgccataagccaatgggccaggcagtgagctgtgggcttgaatgtgtgtaataaaaatagtatgtatatgttgatctagcaattgctgaagtcaaagaaaaagagcacacagggctggctccagagtagacttaattagtgctgtctcaaggttctgtagtaaatacacagagtaagcagaattactaactatattgatgggctgagttgaaaaagtttctaaggccagtatcagagccctaatctcagctctctgctagcaaacagattgagtgattgaatttggtctgtactagactgccacttttctgtttactagacccatcagtaaacagtgttaaagcatcaggtaggggggaatgaactatttttgtaggtaaaatatttactagactttttgggaatgacgaaaatgggtgaattttaagggctgttagaatattatccataaaatgaataatcttgcaatcaggaaattttttttcactagggagcagagcttgattttaattgctccttaactaactcatgggacttttgtaatttctccccctttagaggttagttttgcttaaattggatttggagagtcacgctaggggtaagagaaagagaacagtggccattatcagaaagaggtttttcaaatcttaaattttacttaaatcttagcatagaattatactttgggatgtcgctcctctacaaggagcactcgaaattttgccgtgggccgcctgcggagctggagagctgaggaggcgggtcctggggcagcggcagcgttaccgcttgcaaaggcgccccttttttctgtgctgattttcgcctgtgagacttcctcccacgggcgccgctggctagtcagactttcccgcgtgcctcctgccccgccctaacaggctaacttttccgcgccgggcctggctctttgctgcagctgccgccctcggtgcagagttcccgggagcacttgctggcttcggtttcgcgaacttcctggccgcggagctttcccttctacttaatgcttgctagctcggccgcaccgctccccgccccccgcccccgcccccgcccccgcccccgggatcgggcctctaatgccttttcttaacaccttatgtagctgattgccttgccgatcttgcattacgggcagactaagggccctcttaatgccgcttgcctaagacaaggtcccatagctggagcatgtttcttgtcttttttcctacttattggaggagggggctcaggtgaaacctccctttcctctttgttattttgccccggtgatactggggctgagggaacacaaggcgataaggtgggtgacagttcctcctctttcccctttttaggctcttgcatgtataatggaagcagggctgctctaattaaagcccatagcgttaaagctgttactgggacctgtttcccttgtgcataatgttgtttaagatttctccccacaggccgggcgcggtggctcactcctataatcccagcaccttgggaggctgaggtgggcggatcacctgaggtcgggagttcgagaccagcctgaccaatgtggagcaaccccgtctctgctaaaaatacaaaattagctgggcgtggtggcacatgcctgtaatcccagctactcgggaggctgacgcaggagaatcgcttgaacgtgggaggcggaggttgtggtgagccgagattgtgccattgcacttcagcctgggcaacaagagtgaaactccatctcaaataaataaataaataaataaataaatatttctccccacttgttcccacagcttcatgtttagtgtgcctttttcagggaaccatgggctttgggattcaacagtttgcattaagtcctttaattgagcctgcaaaactgatggtctgctagcctttagcaactgtttcaacacttttatatactgtttctgttgagctgataactgttgtcccatgatgaaatctcagcatgaacaatctcccccgaacttggaaatcccaagtgggcaccaatgacttactgattactcactgaccacgtgtttcctttttcaccttcctttctcgggtccgttctgcttccttcccagtgttcatcacgtgggggcaccggctgtgggggtctgtcccgcagaccctgacccaaggatggatgaataaagtacactgatacacagatactctgctttgccagtccagctgagcgtctgggcagcttacagactacatgcaaagtgccgcaaacagttgccactgcggccagaacagctagtgagactcgcatttattcagtaaagattaattgacaaaggcttgagtcaacaccactagagggtaattgacattgcggacctcccaagtagaaagcaattaagcaccctcagtataacaaaggttagtcttaagaccacatgattaaacaagtttgttagataaactccctacactcctttgtttctaccctaatttatttaactaaaggtaaggggactaggctgccttcagtcagatttattactgaagttatgcgaactctgaggccttccaagaaggtttgtagctattataactaaaatttttcccaccagcctgactgaaccaccacaactgtccactaccatgaccaagagacacaggcagctgatggacatttgaaacgtggctggcccaaatggaaatgtgctggagggtaaaatacacactgcattttgaatgctttgtaagaaaaaaaaggatgtgaaatttctggttaataactgttatatggctgagcgcagtggctcacacctgtaatctcagcactttgggaggctgaggtgggaggatcacttgagaccaggggtttgagaccagtctgggcaacaaagggagagtccatttctacaacagcaacaaaaatattagccaggtatggtggcacatgcctgtgatcccagctactctggaggctgaggcagaggtttgggaggggtggccagcttgtattcccttatttgtccccgcccacatcctgctgatggtccattttacagagtgctgattggtccattttacagagtgctgattagtgcatttacaatcttttagctagacacagagcgctgattggtgcgtttttacagagtgctcattggtgcgtttgcaatcctcctagctagacagaaaagttatccaagtacctgctggacccagaaagtccagctggcttcacctgtcactaggaaagctgagtgtgcatatgggctccacacgctgctggactctgtggcccctaggcactctggggccacactaggagcccccagacagggccctctgctcctggttgagggcagggtgtcaccccattcctcaccaggagggctgcatctctagtgtagcctgccagcctgcagtgccatcaccctagcttatggtgatgacgaggctgagcctcctgaaaggtctgtcaaggggcagcagaaccccccgcagacccagctgctgggccacggagcctccccactggccctgccagccatgctgggacttctcacctgcgcctgacctgctcctgggagggggcttcttcacctccctcccgcataaaattccgccagttttggccaggcatggtggctcacgcctgtaatcccagtactttgggaggccgaggcgggtggattacctgaggttaggagttcgagaccagcctggccaatatggtgaaaccccatctctactgaaaatacaaaattagctgggtgtggtggcacatgcctgtaatcccagccacttgggagactgaggcaggagaatcgcttgaacctgggaggtggaggttgcagtgagcaaataatcatgccattgcactccagcctgggcaatgagagtgaaactccatctcaaaaagaaaagaaaagaaactgggccgggcacagtggctcatgcctgtaatcccagcactttgggaagccaaggcgggtggatcacctgaggttgggagttcaagaccagcctgtccaacatggagaaacctcatctctactaaaaatacaaaattagccgggcgtggtgacacatgcctgtaatcccagctactcgggaggctgaggcaggagaatcacttgaacccaggaggcggaggttgtagtgagccgagatagcaccattgcactccagcctgggcaacaagagtgaaactctgtctcaaaaaaaaaaaattcatccattttaggtgtaaatcaataatttttagctaatgcatgcagttgagcaacgctcaccacaatccagttttcagacacttccatcagcccctgaccccatcgcgacaccactttccgtctctgtggatgtccttctctcagcacttgaggcaaatggaatcagatcatatgtggccttttgcgtttggcttctctcacttagcatgaccttttaaaggggtgtccatgctgtggcatatttttttaattgcaactgatttcttcctctcagagaaggcagctgcacccattcctgaacttgcaaaagaggtgttttaatttggggggcagaatgcccctcttcctgcagcccattctgaacctgccctcccctgccctggtcagcacacctccccttgtgcacctggagatcgtcatactcttcagatctgattctggagaggaaaggaaatatcagctctgtgtcactattttcaatggaaagaccatgagacatctgctccccagcccagtcccttgtcctgcactgacatctccaggtgtggccctgggcatctgcgtgtttaaaatgcccatggtggacagagttgacaatggaaactctgctttctgcttaactcttacattccctcttattttttcaattgagaactaatctttgatttagaaattatgacattcccaagttctactccaatctttttttcgtatttatgtgtcacatgtggcttatttaataattctttggcaattgtacatctcagtctcacaattggcctgatggattaacattttgtttactcaaataattgtgcttggatgataaattagcctgttaacacttctttcttagcaatatgctcactgacaataggcttctttcacatggctgtgtgctcactgcatggatgggatggaatccaaaggtcccatcctcccgacccaagcagcgcacgtggtttcccagtaatctctgtgacgcaaaacctgagagagggaacggcccacaacatgcagtgtcctgagtggacacttttccaattctgttttgccctgttttggtcaaggagtgtgtttgcgcatgcatagaaagagggagaatgtgtgatacacacacgtatgctatttaggtactgacaccaagggtattaaacacatattaactatagaaaagctgatgtttggagctcatctttctgcctctcatgctgcctctaggaatcccctagggtacggaggtggaaacaaacactttcctgctgtgggaacaaccacggtgttgagtctgtcccacctcctttcctaaagccagcctgggcatgcccacaggggcaggggtccccgatgaagggggagcctcatggtatgccagagcaaaacgcaggagacagctgtttcatttggtaggtgttctccatacatgattacaacacctgcaaactgcggctaactatggcacagtgatgtgcacatctgatcccgtgcttgattttaaacggaatgctcctaaagtcttaaatgtggcagttgcaggtcttggtagataacctttaacaagaaaaggaagttcccttataaatgtagtttgcaaagaggttttgtctctttgtttttctttcatgcatccaccagatagatcatgctttgagggcttttttgtggtactttaaaagcactgtactctggttttttgggtttttttgtaggtttttttgagacagagccttgctctgtcacccaggctggagtgcagtggcacgatcttggctcactgccacctccacctcctgggttcaagcgattctcgtgcctcagccacctgagtagctgggattacaggcatgagccatcataccccactaatttttatattttcagtagagacagggttttgccatgttggccgggctggtctcgaactcttgacctcaagtgatccgcctgcctcagcctcccaaagtgctgggattacaggtgtgagccactgcgcccagcagcaatgcactatgtttatttttatggcggttgtccttaagatccacacttacatttatttacttgtatttgtttcataaatttaacagttgtctatttcttttctgccacaaaaagaattttacaaattctcaagcccctccctttgtctctcacccctgtatgtgctctgcctcactgggaaggtttcatgtatacttacgatgagcaggctcacagtgctgtctcttagcctgggtattatgtaaagagacacccattcctctgagaatgaagaaagagaatttcagtattttggttttttcttttctttttttttttgagacagagtctcactctgtcacacacgctggagtgcagtggcgtgatcttggctcactgcaacctccatctcccaagttcaagcaattctcctgcctcagcctcctgagtagctggaattataggcacctgccaccgcccctggcctttttttttgagaatgggtctcgctctgatgcccaggctggagtccagtggtgcgatctcaactcgctgtaacctctccctcctgggctcaagtgcccaggaggggctcaaggctgaggtccctcagcctcccaagtagccgggaccagaggcatgcaccaccatgcttggctaatttttcaatatttttgtagagatggggtctcactatattgcccaggctgatcttgaactcctgggctcaggcaatcctctcgcctcagcctcccaaggtgctgggatcacaggctgagccctcgccaggcctaaatgcacatttctagctctgagctgtctgttgatggcctttgccaattccttctcattttcctttttagtgtctgttacgtaatacttgttgattgtagaaattagaaaaaacaaagaaactaaaaggtagaaaaaagtgtcagtcgcctaaattcccaacatagagccacattacatgtttcactctgtggcgtttcaggtttctctcagatgttcaccacatagacctgatgtggaaattgccacactgtaaatggtgatgctacatgttcagacattgagatgacctcataaatttccttcaggtattaactttaggaaatgctccttacataaaccccagtgctccaatgttgacatggaaagagacattcagagtagaggaacagctttcattgaaatcttgattttgttctcaaattacccttagggatgacatgatcccttccaaaccagcacagacacgactacagtccattctcctctgctggatgtagtttcaggattttcccatctttatttctttttaatatttgagaagcataaagatttgcttatgagctcttagattatttaaaattatttgttgtgttaacagacaccggaaaggataagaaaaaataaattttaattcctccaaacggttttatattaggcaattattttttacttctttaatttgcttacatcatacatagaaaaacaatcatagaactcatctgaaatacctactgtcaacggggcgcagtggctcatacctgtaatcccagcactttgggaggcagaggtgggaggatcacttgaggccaggggtttgagaccagcctggacaacatagtgagacctggtctctacaaaaaatacaaaaatttgccaggtgtggtggcttgcacctgtggtcccagctactcctgcttgggagctgaggtgggagaatcacttgagttcgaggctgcagtgagctatgatcccgccactgcacttctgcctgagtgacacagcaaaactctgtctctaaaatggaaaaagaaatatcactattggctgggcgcggtggctcaagcctgtaatcccagcactttgggaggctgaggtgggagaatcacctgagttcaggagttcaagaccagcctggccaacattgtgaaaccaagtttctaaatacaaaatttggctgggcatgggcctggcgcagtggctcacgcctgtaatcccagcactctgggaggccgaggcgtgtggatcatgaggtcaggagattgagaccatcctggctaacacagtgaaaccctgtctctaccaaaaatacaaaaaaaaattagccggacgtggttgtgggcgcctgtagtcccagctactcgggaggctgaggcaggagaaaggcgtgaacccgggaggcggagcttgcagcgagccaagatcgcgccactgcactccagcctgggagacaaagcaagactacgtctcaaaaaaaaaaaaaaatgagctgggcatggtggtgggcacctgtaatcccagctactggggaggctgaggcagaagaattgcttgaacctgggaggcagaggttgcagggagccaagattgtgccactgcactccaacctggatgatagagcgagactgtctcaaaaaaagaaagaaagaaagaaagatctactgctgtttatttttgtttccttctttctcttccttttattccctttttcttctttctttctcattgcccctccctctctcccctgttctccttctttctctgtaggatggacccgagagggcagacgctcctccgccgcatggtggcagaagggcagggccgagatgtctgggagactatgaagtctggtttagggtctttcaatgtggggctggttaggattagggtaagggtcacaacacagcaatttagaagtggcaaacacagcaaggtgagggttcagagagccctaggagtaaacttgtttctgctttctaccgaagagttgatgggcctttctggaagttgctggaatgaatgatgaagttgtctcctagaaagcaggactgttctgggaaggcagccccaaagctatggccactggtgcggatgctaagccgtgggctcggccttggcgccccccgtggtcagaggacaccgccagtgaggggacgatccatgcagttccccacagctgagtgccatccaggatgggtgtttcagcccccgtgcagttcccctgcttcccttgctggatgatcattttgggatcatttgcagggcagcacctgcacagcagcattttgactcaaacactgagccaggcgcggtggcttacgcctgtaatcccagaactttgggaggtcgaggcaggcagatcacttgaggtcaggagttcgagaccagcctggccaacatggtgaaagtccacctctactaaaatacaaacattagccaggcatggtgacgcacacctatactcccagctattcaggaggctgaggcacgagatgaaaatcacttgaacctgggaggtggaggttgcagtgagccgagattgagtcacagcactccagcctggatgacagagcgagactctctctcaaaaaaaaaaaaaaaaaaatcaaacactgggctgggcatggtgtctcacgcctataatcccagtgctttgggaggctgagctggaggccagaagttccagaccagcctgggcaacacagcaagaacctgtctcttcaaaaaacttatgcacaactctagctcactgcaacctcaaactcctggattcaagtgaccctcccacctcagcctcctgagtagcttggactacagggatgccaccaccccagctcatctgcagcatcccagtcatcaggtaggtctaaagcaaaagaaagcgatagggtcctgtaaggcctgtgagagtgaggctgcctgcacctgggctccaccagctccctgccaccttctaggctctagctcagtgacagcccagtgcaaagagcagctcctgccagagccccggcactgttaggaacatcaagacagaaaggcttccatttcagatgcctggcctgttgtggtttctgctccaaaaaaaatcacctaatggttgagtccagttgcccaggaacaagagattgcaatgaagcgaacctgggtgagttccaaagaaaactgaacaagggacaggcgctctggccagcatgcttccccgcgtctgccactttgagggtaaatcacacgcaggaccagccccagaccacgctgtcttggctatcccaggaccacagcgggcacagacctggcccttcactgacagcacccccaccccgacccacagcagtgcccctcacggagccttgaagctatggtagggggcattcagtgattcatgcaggtccgtaagtgagccccagaagaccatggggccctggcctgcctcccacaccctcgtccccagcccaggcctgaggctccccacagatgctgcccctttgggaatgggagcaaaatgggacccagaaagagtctgtctcaggccttccagagcaggatgggtctcctccaataggtgcctcttaacccaccaggggtcatggacccttggagagctgaacaaattggctgtctcagaaaatgcactttgtcacctacacacacaattctgaatacacctatcctgcacaccagcatgaacgcgatttcacaaaccaggctccatgggcctcaagtacggactggtcctcgaggtagacttgcttctgaggactgttaatgggcccctcagaccctagaggaggcagcgcagatcagacctggtgcctcccacgatcagactggcggccggcggcctggcaactggtggggaggaggtttttactcagccacgagctgctggccaggtccaatggggagacagtcaggggcttggacatggaatcagttcactgtcagacagcccaggtcccggtgatgaggatatctactcatcatgatgacaacactcagggcagctgggccacgtgctggacagcccagctttcagcaggggttaggccgatggtgcacaggacaggctcagcctggggaaaggatgtccctgccattttgctagcctggaagtgctctggaaggaggacagaaaacctgccttagccagggcatcccagggcattgagacaacaggaggacaggcgtgcgcacctccgggagcaggcgggaggggggctgaggaggggctgggggctctgggccagggaggcaggggatggcctggggctggaggtgtctcaggacagaagaagctgggcttcactggcagctgcactggccctgagtactcctcacctcctgccctgccgatcgtcagccaagcgttctggaaagaacagcgtgaaagcagagccagccagagaaagccaaggagagttcatggaaacagcaagaacggcatggtgtcggaaggcaggaccacctctgtgacctcgggggcagtgctgccctctgcgaggcagatagggatgagcctgcgtctgctgcccacccagcagcgcctgagctaaaccccctgcgccaccatgaacaaacatctggcatcaactcactcgctgcccccaccccccctcaatctgctttggtagagaagagcctgggttcaggctgagcactggctatgctgaccctccccgtcacctggggagaccggcggaggtggcagcatgaggaagtggaccccagagagcacaagtgacagaagtcccgggagccagagggtggggctggactttgactcacagcgcctgatttcagatgctgggttggccacacgctagctgtgcaatcttggacaagtgactccacgtccctgggcttcctctcactttttcaaaactggtggttgtaggcattgaatgagttaaagtaccaagtgctcagaactaggacaagcacaaggagttatccagggctggttctcctgacagagaatgtcctcgctgcagaggttgtgagagaacttcattaacctttggggatcccgcgtcctcacagctccatcctgaggccgcctgggatgctggtgctgcgcctttgtcaggccccagcaggagggccataatgaactacaagtcctcagacccggatccctttggtagaactgctaggatgaatgctgcccacactggagtgtgcagcagattgccctggagagtgttaaaataacataaaacaaaactattcttgaaaaaattacatttacactaaagtggtccatcccctggaggccaggggaggcccctcttcaggcccagattctattctaggaccataatatttccatgaaaaggagaaaaagtgctgcctcagagacccaccccccaccaggggaagcctgggcctgggaccccttcagtaggggtctgaagcccaggtcttcctggagatgcttttacactgtttggtctttgaaatatttccattttgagatgttcttctctgaaaactcctcctcattcagagcctgcctacagccggccctggagcatggaggtcacagtctgacttggtacagggacaccacctgggtttcggatgagtggacagttttctgtcatttttccctgcacttcttgtctcctcttcttgtttagatgattttttgcttattcctttctatttctgcagttcttgttttctcttttcttttttttttttttccaagatagggttttgctttgtcacccaggctggagtgcagtgaagcaatcagctcactgcagcctccacctccctggctcaagcgatcctcccacctcagcctcctgcgtagctgggaccacaggtgcacaccaccacacctgtctaatttgtttgtttgagttttttttggtagagatggggtctcaccatgttgcccaggtgggtctggaactgctgggctcaagcgattctccagcctcagcctcccaaagtgctgggattacaggcgtgagccaccgtgcctggcctggctaatccttttcttttctttcttcctttctgtggatcgaaggccttctctgccactcaccacagcactgtgcttcctgccttccctgccctgggagcctctgcaggccagagccccagcaagtgcagccttgtggctgtacacctgaactgccttccttccctgtggctggaacttcctcccagattgtcgctgtgcacctggcctggcttccagaggccttgggtgattccctgggtgaggcccattcctagccttgcaggttttcagaaggtaactttgctgctttggccagaaggccgcaatgtggcagtattcagcaacgtggcatttctgtgcagagttttaaactttggttcagttcgttgctgattcatttgatgtcttaaggagcatggagctccaagaataaaatggtaataagtgaggacttccagttctgattctgcacgtaaggagcttggaagatatctttcagtagatatctggcactaggttccctgcagcctactcccaaggaaatcatttccgagctgggcttttccaacctcgagtttggccaggccgcatcccctctccccagcagccctgccgcctccctgcactctcatgcatgcctctggtttgcagtgatggctgctccctccgccaatgtcacctgctgttcatgcagcacgtggccgcaccttctggtcagtgctctgactcacctgcctgtcagttattcttctgtgggccaggtcttcaggatgatcctttgctggttccttgtccctaagttatctccaaaggtgagtttttcccaaaccaggtttttgcaggacgtttgtgctggggggatcaagggctgtgttctaggcttgtgcaggctttgttacaatccagtttggtgtgtcatcattttcctcattttaaaggaataaatgaggctgggtgtagtggctcaagcctgtaatcccagcacttttggaggctgaggtgggaggatcgcttgggctcaagaagtcaaggctgcagagagttgggatggtaccactgcactccagcctggatgatagagtgagaccctgtctcaaagagaaaaaaaaacgaataaacaagatatcatgtgtgagagaggttataaaggtaaggtataaataataaatagaaagactccgcatagaaagcaggacatgccatgtcctcaggtggcctctgtgtgcttgagcctgagtcagcctctcaagggtgcgaccgctggccttggaggtgagcgcatcccctgacccaccccaggctccactcttgtccttggtgtgaattgtttccttgctgcttgttgtggttttattttgtgttgtgccctgaaagaacacaccagggggtttcatgtgccctccccttcctctgtgcctggtcttgtccctgcctcaccctcggccaaggggccagcctctgcagacctgcctttgtgatgtcatcttccctatgatcagacactaaactcaggaaggcaccaagactggcggcatggctttacacccaaaccatcttggtgcttcatgacagccagatccctcacctcactgcccgagatggcagccacatgagacaggccctggaaataacaggtaccgtgatgtccttgacctttaattagctccacattttctatttgctactcaccgaagagctgacctgctgacctgtttatgcagcccacagggcggaaaaagttctaaaatctaaaagtgaagctcagaggctaattttgtatatgcaaaatgtacaagatatgaataaagtgttatattaataaaatgccctagaactcgtactctttccagagggaatgggaaggcctggggccgcatccatgtcctggctgtgctgtgctgcgtgcccctggggaaatccctaccaaatcactctgggtcgaacctcatgaggggttacttctcctctcgactcttctgttgccagctagtgtcattatttaatcaggctgtcaggtcatctcgggatagatggtttctgcttttctgccatgcttgcctggagactcagtttaagctaaaagctagaaactgtatctccaacagaggactgtctcaaagccagggtggaaagagccggattggacactcagcaaatgacaccatgaggacatggctggtggtgcaggcatcttcgcaccagacaacgttacatgtgagactgcgcccaggagccgagtgaggtttctaggactctcaggagggagcagaaggaagcaactccccatgactccatggctggctggggcacaagctcacattcgggaagccacagaggggagcgtcttgtcactttgtgccttagcactgcggtgccctcagtgtggggtgagcaaaatcacaccttttctaggaataggcccttacactgactgacagactccacagataaacagtgatgtggcttcccccgctcatgggaagtgcatggtgaagaagagaatgcactgagtgagtaatgtccgagcgtgcctgctgccccagcctcctaccccacaggggagatgcctggggtccggctcgggacgcacggcagtccagcttccctagggacacccctgcctgctcgtcctctgcttcaggcctgatcatcatcgccaaggagaaacctcatgtttttaagaagtccctgtggtggtcagccaagggactgcttctttgctcacagcaaggcaggatgctgaggaggagtttgagagccaggctgaaaacagtgaggtggatgcaggagccagctgggatcctggccaagggggtggagagagagtcgcaagctggctgtggcttctctgcatttccaatttgcctttctatagaataatgataagagagcctccccactggtgggtcatgtattttcaatgagttaatatgtgcaaagggacgggcatggaggtcagaacttcaagaccagcctgaccaacatggtgaaaacccgtctctactaaaaatacaaaaattagctgggtgtggtggcacaagcctgtaatccctgctattcaggaggctgaggcaggagaatcacttgaacccgggagatggaggttgcagtaagccgagatcacgccactgcactccagcctgggcgacagagtgagactccgtctcaaacaaaaaaaaaaaattgcaaagagcatcaaacagtgcagcgtcatgagtgagctcatgctctggccccttattttcatttagtgccactggagaccttgaggaagggggtccctttgaaatttggtgaccaacatccatccatctcagctctgtcctggaggtcagctaagatcatgggtaagtgctttgccaagaccactcgctacaatgtgtctctggaacaacatccccttattgccgcagtgcagttccaagctcctgctggagccggtgcctgtctggacacctccccaccacccctactggagaacctaacattcctgcctccgtttttgcctgcagttcttcaacatagaatctctgctcccaggagcagggtggtttttgtttttgtttttgttttttttgcaggggggttgggtgcgtatcagttgtcaggcctctgagcccaagctaagccgtcatatcccctgtgacctgcacgtatacatccagatggcctgaagcaactgaagatccacaaaagaagtgaaaatagccttaactgatgacattccaccattgtaatttgtttctgccccaccctaactgatcaatgtactttgtaatctcccccacccttaagaaggttctttataatctcccccacccttaagaaggttctttgtaattctccccacccttgagaacgtacttttcgagatccaccccctgcccacaaaacattgcttctaactccactgcctatccccaaacttataagaactaatgataatcccaccaccctttgctgactcttttcagactcagcccgcctgcacacaggtgaaataaacagccttgttgctcacacaaagcctgtttggtggtctcttcacacggacacatgagacatcagtaattctatttcgaacatgctcaatttgaaatgggcattagatatctgatatggtttggatctgtgtcgccacccaaatctcctgttcaattgtaatccccagtgttggaggtggggcctggcgggaggtaatttgatcatgggggcggagttctcatgaatgggtcagcaccatcccctcggcactgttctcctcttagtgagtgagttcgggagggatccgactgtttgaaagtgtggggcatctccccattccctgtcttgctcctggtcctgccatgtgagacacctgctcccgctctgccttctgccatgagtgaaagctccctgaggcctccccagaagcagatgctgccatgcttcctgtacagcctgcagaactgtgagccaattaaacctcttttgtttataaattacccagtctcaggcctttcttcagcagtgtgagaacggactaatacagcatccaagcatgatgtgtgtgaggcagttggctgcttgagcctgtgtctataaaaacaagctggagacagtggcttggggagtcagcatgcagatgaaatttaaaaatcatggctcgataccttcatttaaggagggtgaagagatcaaaagaagggtccaaggctggatggaggctgcaccactgccaccacaaaggtgagaaagtgagacccagggaggccccctgagaaaggctgaagaccagggaatgctgtctcaagccaagtgaggaaaggccttcaaagagatggtgaggtccaccggaaggctgggcagggtatgggagggagatggctgacctggagattcggagagggtgcagtgactggtaatactgaggtctagagtctcatgggtgttcacagtgggacagaggtgttatcataaggatggcatattataaaggatgcttccaggttcaagtacaggaaatcctggccaaagtggcttaaacaacagggtgttggccaggcatggtggctcatgcctgtaatcccagcactttgggaggccaaggcgggcagatcagctgaggtcaggagttcaagaccagtctggccaacgcggcaaaaccccatctctactaaaaaatacaaaaattagctgggcttggtggcacgcacctgtaatcccagctacttaggaagctgaggcaggagaatgatttgaacccgggaggcaaaagttgcagtgagccgagatcgcaccattgcactccagcctggacgacagagcaaaactccgtatcaaaaaaaaaaagaaataaatgaagaaaaagaaagaaagagagagggagggagggaaggaaggaaaggaaggaaaggaaagaaaggaaaaaaaggaagaaagtcatggatgcctccgcagctccccacgtcatttaccaaggccacttgcccataccacagacagagagtccttggtttctggtcctgccagtcagaattgggcggaactgccaagttggcccaaccctactccaatccctgacaaagggagcggccttcaggaggctcggctctctgtgcactttgctcaagatacctgaagaatgattactttgaggaagaaaggaagacttttaggaaagaagcgactttgttttcgcggtcaaggagcgaaggccccaagagaccaaggtagacgctgaaggaatccgggaagatgacagaagcggtgaagagacgcgaggtggggccaaaatcttcactaaccaacaaggagggctgcgggggctttggagggcctcttttctcgcaaccgtggcccctccgcccctcacctgccccttgagtgtctgtgcaggggtctcacacgcgagcttggctactcagaccaagccggtttaccgtcaccatggcaacagcgcgtcctgggctggggcggggccagactgccagtgcctttgtggcgcattaggagctaagccagtgattggccatctgggcgcggggcgggctgagtcagttggagggggcggggctgaggctccggtgaacgccgtaggcccgggctgggccgagggagatgatggatgccgcttcttgccactccccgggggcaccacagagagcggggagcctgcagagagcagggacagcggcttcaaacgcactgtttccgggcaatgtcactaataccaaagtcatgcctcccactggacactcctgggctcccatccttcctaccaagaaactttctctgtgaaacccacgaaacagctagaaatggagcccaaaagatagccaggataacagaccacagagaggatcaaggcccagcaggacctggcgactctaacgctctggcactagggtgtctagaatgggaagcccccaaggggctggagtgggatgggggtgtgatgcaggccgcccaccaggttccctccgggcaaagcggcagggccccgcgcttcctgagccttcacggaggtctagtggtccctctgcctgaaaacctgtctgtttgtcaggaggagttcggagcatataattttggggagccattttcttctagggagttcactttcctgtgcggggcggcggaggaagacaacacataactgaacgacagatgaagataaattataaaagaacattgtttaagtgtttaatcagacaatgaagagaaacccaaaacaatgaaaccttttcaaggaagtaaggtacacaataaaaaatctcttggaggaagtatcaaagcttaaagatgagtggaaaatcggcttgctttttggggaccaaaagaaaacagattttttgtttgtttgttttttgagacggagtctcgctctgtcgcccaggctggagtgcagtggcgcaatctcggctcactgcaagctccgtttcccgggttcaagccattgtcctgcctcagccgcccgagtagctggaactacaggcgctcgccaccacgcccggctaattttttgtatttttagtagagacggggtttcacatgttagccaggatggtcttgatctcctgacctcgtgatccacccgcctcggccttccaaagtgctgggattgcaggtgtgagccaccgcacccggacttttttttcttaacacagagtcttgctctatcgcccaggctggagtgtagtggctcgattctggctcactgcaacctccagttcccaggttcaagtaattctagtgcctcagcctcccaagtagatgagattacaggcatgtgccaccgcgcccagctaatttttgtatttttagtagagacgaagtttctccatgttgaccaagttggtcttgaactcctggcctcaagtgatccatctgcctcagcctcccaaagtgatgggattacaggtgtgaaccactgctcccagccgaatttttaaaatatacttgaaagctggttatctatgagctgatggcaagtttttttttttttttttaaagacagagtgtcactctgtcgcccaggatggagtgcagtggtacaatcatagctcactgcagtctcaacctcccaggcttaagcaatccttccacctcagcctcctgagtagctgggaccacaggcgcacaccaccacacctggctaattttattttttatttttatttttgtagagatgggggtctcattatgttgcccaggctggtctggagctcctgggttcaagcgatcctcccaccttggcctcccaaagtgctgggattacaggtatgagccaccatgcttggccccagttgcaagattttattaaaaattttataggtcaaaaatgtagaggttaaaagaccctcctgaggaagctaaacaaagtgcagacaggtacaaagctgaactccatcggctcaaagaaaacagtgcccggcagaagatgccagagcagttacattcaggaagctccatgccagtgggagcagccccctgagtgagaactccctggactatctgttctagaagccctgccttacagagtggatgatgtgaaattgtgagcagtttcagctgtaggcagcaaaaacttggcccaacaacagaaagagaagataaaacatcagaggagagagaggacagatgtcacccagacaaattctttcttaacaagggttgaaaaaggaggcggctagttcccatgcagtgtgagccatgggtggtgggcaagatcacaacacactgcacaaggcagaggcaagatgtgagaatgaatgcaagtccttgccgggagtccccatgaccccatcagccacaggccggggcactgcaacagaggcagactgcacatggacgtgtggtgtctgcatgggctgcatggaccctcacatgcccactccacagctccatcacaggcctctgcaaagacctcctgttgccccgccttctcttattagtttcctgggctgctgtaacaaattacaacgaacttagtgacttaaaagaacagcctagttttttctcacaggtcctggagtccagaactctgaagttaaggtgtcagcaaagctgcacttcctccagagcctctagggtagaacccatgccttgcctatggtggctgcgggtgttcctggacttgtggctgtacaccccaatgtctgctcccaccatcacgtggccttccaactgtgtgtgtctaatctcgcactacctctctctcacaaggacacttatgatggcattcagggcccacccagataacccaggatgaccctcacctgaggatgcttaaatgaatcacacgtacaaagaccctttttccaagtaaggtcacattcacagatttcaggaagagaacatggacacacattgctggggtggcatttttcagcccaccacacctcccagtctttctccttctagacccctgatcaccagcccagccatcagccactgtccatcagtttcatgtttactctaacctcagtccgcttctttccacatagtgaatgacggttgctctgtcagaatttctgcctattgggaggactttcccccaccactgtttttcagggctgtcccatggcaggctatagcacagcagcatttggggcttacatccacctatcaagccatgacccaagtttggcccctttactcccacctctaccccaattctgagctgagtgagacaggggcccgatgcaacctttgcagacaatatggggcctgggccacctgcttgtgcagctcctggctgccacatggccctgctctggcccagaatggaatgcaccatcaccatcatactgtgaatggggctgttgggcccaccactgattttataacttgggttctagccgaacccagctcaggatgggcagttctggctgcagagtcgcttgatgtctgttgctgggtgctctgcctccatcagggcccggtggcatgctgggagctgttctggttgggtttggttttttgggtggtatatgtataattatcagttacagatggtgtggtcttgatccagaaccctaattgtctgtattgtgattctcccatgggaacctgtcgtaaactccaaatgccctctttttctaccatagatacctcgtatacattaaggtctgctggatcttatgatggaaggagcagggctgctgacccacatcctgaacttgctacagagccctttccagctctgggcccagagccttcatatagctcaataagggggccagagcagcatgcccacctatggggtttgctacctttaaacccaagggagcctactaagcatcgtgctttattctcgttggtgggaagtatgagatgcaatcatttgtcttttactttggaaggaatgtccaagcatgtcccaaaccactggatccctgaagtctccacaaatgtgtttagcaggctggaagatacaaggtcaatatatatatcaattaattaggtatacaaaaataaagtgcattcagaggccaagcaaggaggatttcttgagaccaagcgttcgagaccagcttgggcaacatagtgagatcccatctctacaaaaagttttaaaattagccatgtgtggtggctcctctcacctcaacctcctgagaaacctgtagttctagctacttgagaggttgaggcagaaaaatcccttgagcccaggagttgaaggttacagtgagctatgatcataccactgcactccaacctgggtgacagagaaagaccctatctcttaaaaaaaaattaaattaactcaaaatggatcatacacctaaacatagtttttgtgttagctaaaactataagccttatagttttacccatgctatcatgggttatatattaacccatgctatcatgggttaatctcagctgatctggattaaccacattgtgacggttaattttaggtgttgacatgactggattaagaaatacctacaaaactggcaaaacagtacttctggatgtgtctgtgagggtgtttcaaggagactgatgtgtgagttgctgcactgagtcgggaagatgttcctcaatgtgggcagccaccattcaattggctgggtgtccagagagaacaaaaaaggaaggaaaaggattttccctctctctcctggaactgggacactctcctcttcctgccccccggttctcacgacttcagcctcagacagagacttacataattggtttccctggttctaaggtctctggacttggactgggccatgctaccagcatctcagagttgccagcttgtagacagcctgttgtgcgacttctcaacctctgtaatcaagtgagctaattcccctaacaaaccccctctcatatgtctatatctatcgatagctcctattgatctgcctctctgtagaaccctgaccaatgcacacatgcttattacaaggtattgacccttggccaatgctgtgcaatggattaactaaagataaagatgttctataactatgagtctgtgagttgcttcagggcaggactaccagcctgtcagcattgttcaataataattgaactcattatttgtacctggttttagaggggtctggaaaattttgaaagctaaagctggtcacaaagtcggaacatacctatgtgatcagctcactctaagactcccaccatgagccgacttcaggcttcttgggaccgaggtgcttccacacacagtgttcaagggcaagatctgaaatcaaagtgcatcctatgtgtcccagtgttaaaaatatctagatctcaaagtccctttagtgcatagccttctgcttttgctactgtgcctataaaaaagcacaagtataaaccgagtcctgcacgtcctttcagcagctgaactcttagggtgattaatgtgtaattcacacaaattccttaaagaaggcataggagaacatcttaacaacctttggtttggcaaagattacttagataagacacaaacagcataatccatgaaggcaacaaatcaataaattgaactttctcaaaattaaaactttggctctacaaaagactgttagaaagaaaaagggagctatatactgtgaaaaatatttgcgaaatatatatccaacaaaaaacatgaatctggaatacataaagaactcccataactcaataataagaagacaaacaacccaatttttaaaaatccaattcatatgtgagcaaaagacataaatatatatttcaccaaaaagggtatacattcgcaaataagcttattaaatgatgctcaacatgattagctattagagaaactcaaataaacccacaatcactatacacctatcacagtgactaaaataaagaacagtggcctctccctctccctctccctctggtctccctctgttgctgaggctggactatactgccgtggtctcagctagctgcagcctccctgccccgggctcccgtggttctcctgcctcggcctgccgagtgcctgggattgtgggcgagcgccgccgcgcctgactggtttttgtatttttggaggagacagggtttcccctgttgaccgggctggtctccggctcctgacctcaagtagtctgcctgcctcggcctcccagggtgctgggattgcagacggagtctcgctcactcaatgctcagtgttgcccaggctggagtgcagtggtgtgatctcggttcgctgcaacctccaccttccagctgcctgccttggcctcccaaagtgctacgattactgcctctgcctggccgccaccccatctgggaagtggggagcgtctctgcctggctgcccatcgtctgggatgtggggagcccctctgcccggccgccccgtttgggaagtgaggagtgcctctgcctggccgccaccccgtctgggaagtgaggagcgtctctgcctggccgcccatcgtttgggatgtgaggagcgcctctgcccgccggcctcctctgggatgtgaggagcgcctatgcccggccaccccgtctgtgaagtgaggagcacctctgcccggctgccccgtctgggaagtgaggagcgcctctgcccggctgccaccccgtctgtgaggtgaggagtgtctctgccaggccaccaccctgtctgggatgtgaggagcccctctgcccggctgccccgtctgggaagcgaggagtgcctctacctgaccgccctgtctgggaagtgaggagcacctatgcccggccgccccatctgggaagcgaggagcacctctgcctgaccgcccatcatctgggaagtgaggatcgcctctgcccggccgccccgtctgggaggtgaggggcatctctgcccggccaccccatctggaaggtgaggagcgcctctgcctggccgccccgcctgggaagtgaggagcgcctctgcccggccgcccttcgtctgggaggtggggagcacctctgcccggctgccccatctgggaagtgggtgcctctgcctggccgccccatctgggaggtgaggggcgtctatgcccggccaccccatctgggaggtgaggagcacctctgcccggccgccccgtctgggaggtggggagcgcctctgcccagccgcccatcgtctgggaggtggggagcacctctgccaggccaccccatctgggaagtgtacccaacagctcggaagagacagcaaccatcgagaacgggccatgatgatgatggtggttttgtcgtaaagaaaagggggaaatgtggggaaaagaaagagagatcagattgttactgtgtctgtgtagaaagaagtagacataggagactccattttgttctgtactaagaaaaattcttctgccttgggatgctgttaatttataaccttacccccaaccccgtgctctctgaaacatgtgctatgtcaactcagggttaaatggattaagggtggtgcaagatgtgctttgttaaacagatgcttgaaggcagcatgctcgttaagagtcatcaccactccctaatctcaagtacccagggacacaaacacggccgaaggccgcagggacctctgcctaggaaaaccagagacctttgttctcgtgtttatctgctgaccttctctccactattatcctatgaccctgccacatccccctctctgagaaacacccaagaatgatcaataaatactaaaaaaaaaaaaaaaaaaaaaaaaagagaacagtggcttggtgtagtgtcccacacctgcagtttcagcactttggaaggctgagggggaaagactgcctgagcccaggagttcaagactagcctgggcaacatagtgagacccaatctctacaaaaaataattagctgggcatgatggctcacacctgtagtcccagctatttgggagactgaggtgggaggatcgcttgagcccaggagatcgaggctgcattgagccgagattatgccactgcactccagcctgggtgacacagcaaaaccctgcctcaaaaaaaaaaaaaaagaaagaaaaaaaaatagtgataacaccaaatgatagtgaggatgcagaaaaactagaccacacattactgttaggaatgtggccaggcacggtggctcatgcctgtaatcccagcattttgggagacagaggcaggtggattacttgaggtcaggagtttgagaccagcctggccaacatgatgaaaccctatctctactaaaaatatttaaaaattagccaggagtggtggcgggcacctgtaatcccagctactcaggagtctgaggcaggagaatggcttgaacctgggaggtggtggttgcagtgagccaagatcaggccactgcactccatcctgggcaacagagcaagactccatctcacaaaaaaaataatgtaaaatggtacaggcaccctggaaaatagcttggtagtttctttctttttttctttctttttttttttttttaagatggagttttgctcttgttgcccaggctggagtgcaatggtgagatctcggctcactgcaacctccgcctcctgggttcaagcaattctcctgcctcagcctcctgagtagctgggattacaggtgcgcaccatcatgcctggctaattttttgtatttttagtagaaacggggttttaccatgttagccaggctggtcttgaactcctgaactcaggtgatcctcccgcttcagcctcccaaagtgctgggattacaggtgtgagccaccatgcccagccggtagtctcttataaaactaaatatatactggccataaaacccagaaaccacactcacatttatcacagagaaatgaaaactgttcacaccaacacctggccacaaatgtccacagcagcattattcacaattgccaaaaactggaaaaaacacaaatgctcttcaatgggtgaatggttaaagaaactttgatacccccataccatgtaatactactcagcaataaaaaggaaccgacaattgatatattcaacaacttggatggatctcaagcaaattacgctcagtgaaaaagagccagttcaaaaggccatatactgtgtgattccatttatataacatttttgaaatgacaaaatagacagatgaaaatcagattagcagttgccagggtttaggggcagaggaggagggggcggacataggtaaagggttagcatgaaggacttctgtggtgataattattctgtatcttgattgtggtgctggttacacgaacctacacatgtgataaaattgcattgaactattcacacgcatacatacaacacacacaagtgagtgcatgtgacactgatgaagtacaaacaagctctgaggactgtatcaacatcagcgtcctggctttgatattaaaccatagttagagaagatgttatcattgggggaaactgggtgaaacgtacacgaaacttcctcgaacttttttttttttttgcaacttcctgtgggtttataatcatttcgaaatttatcctctttttttttttgagacagagtctcactctgtcacccaggttggagtgcaatagcctgatctcggcttactgcaacctctccctcccaggttcaagcaattcttctgtctcagcatcccatgtagctgggattacaggcacgcaccaccacacccggctaatttttgtatttttagtagagatggggtttcaacatgttggccaggccggtcttgaactcctgacctcaagtgatccgccagccttggcctaccaaagtgctgggattacaggcatgagccactgcacctggcccaaattttaaaattcttaacatatattatttttaaaatgcttctccacccactcctctccaccgctgtacttctgttgctatctcaggcagtggtccatgaaggccagcaccacaaataaagctacaactgctcagtgtttatgtaacacccagataaaaccacccccacccttctccatgtcatctcaatgtagtgacatagccaaaagtaacgcaggtccaaaaccctgagcagtcatggagagctttgcttcaagttttcttgggaggactgtggagagtaggctcccatctcatgatgcaaagcaaaacttcctgatgtcgtccttcccacccccgaccaaagctgcgctttaaagcagatcctccagtatctcctcccctctccccatctgcttctctccccctaagcttccagccttctcttcctctcccctcccatcccctccaacaggactgctggatttccggcaaaaactcccaggtctgttctaacatggatcagcctgggctcttcccatctctgcccactcccacagcaaaggccccataaggagcagccaaacactcgcacctcctcatgacacaaaggaaagggaaggctgtgaacagccacttgcgctgtagcatttttgtttctgttttttttttaaaaaaaaatgggtaggccgggcacggtggctcacgcctgtaatcccagcactttgggatgccaaggcaggcagatcacaaggtcaggagttcgagaccagcctgaccaacatggtgaaaccccatctctactaaaaatacaaaaattaaccgggtgtggtggcacgcaactgtgatcccagctacttgggaagctgaggcaggagaattgcttgaacccgggaggcagaggttgcagtgagctgagattgcgacgatgcactccagcctgggtgacaaagcaagactctgtctcaaaaataaataaataaataaataaaatggataaaagatttggagaatcacctcagcaaagaagataagctgatggcaaataagcacaggaaaagatgctcaacatcattagtcattagggaaacactcattgaaaccatgaagagacaccgcgacacacccactaggatggctacaaccaaagagactcaccatggcaagtggtagtgagggtgtgaagaaactgggacattcatgcactgctggtgggaatgtgaaatggcacaaccatttcggaagacagtttggcaggttcttatgaagttaagcatacagccagggatggtggctcacacctaatactttgggctttgggaggtggaggagggtggatggcttgagcccagcccaggagttagagactagcctgggtaacatggcgagaccctgttttgccatgtcacccaggctctgtcaaccaggctggagtgcagtggcacaatctccactcactgcaacttccacctcccaggttcaagcgattctcctgtctcagcctcccaagtaactaggattacaggtacgtgccaccacaatgtgctaatttttgtattttagtagagatggggtttcaccatgttggcaggctagtcttgaactcttgacctcaggtgatccacccacctcagcctcccaaagtgctgggattacaggcgtgagccacgcgcctggcctgcaagaccctgtttccaaaaataaaaaagttaaacctgccatatgactcagtcacttcactcgtagggatttacccaggtttcatgaaaacatagtccacacaagacctgcacagtaatatgtatagacactttattggtaatagttagaaactggaaacaacccaagtgtccatcaacagaagaatgcagccaggcacagtggctcatccctgtagtcccagcactttgggaggctgaggtgggcggatcatgaggtcaggagttcaagaccagtctggccaacatggtgaaactccacctctactaaaaatacaaaaattagcggcacatggtggcatgtgcctgtaatcccagctactcgggaggctgaggcaggagtatcgattaaacccgggaggcggaggttgcagtgagctgagatagagccactgggcaacagagcaagactccatctcgggggcaaaaaaaaaaaaaaaagaagaatgcataaattatggcacatccatgctatggaatactgtttagcaattttaaaagaatgaactgcactccaacctgggtgacagagcaagaccctgtctaaaaaagaaaaaaagaaaaaataataataaactattgatattcacatcactacagataaatctcaaaataattatgctaatggaaagaagccagacaaaagagtacacattgtatgattccatctatataaaattctagaaatcgcaaatgaatcaaacagaaagcagatcagtgcttgcctgtggcattgccttgcctctccaaggggtccttgggggagggagaaaaggatcacagaagggcataaggaaagttttcagtgatggatgtagtcatttttttgattgtggtgattatttcaccgggtatatatatatatatattcttccaattttggccgagtgcggtggctgtcacctataatcccagcactttggtagcctgaggcaagaggactccttgagcccaggaattcaagaccaggcgtggtgtagccgggcgtggtggtgcacacctgtagtcccagctactcaggaggctgaggtgggagcatttcttgcgcccaggaggtggaggttgcagtacgctacgatcatgccactgcactctagcgtgggtgacagagctcacttgaatctgggaggcagagtttgtggtgagccaagattgtgccattgcactccagcctgggcaacaagtatgaaactccgtctaaaaaaaaaagaaaagaaaaaaaagaaatcaatgtggctgctctcaaaacaccagatacgtctattgaatcatgcatagaacctgggaaagggacctctgggtggattcctgaatgcagtggacctacagtgagttgggcctgggtcaaaactctattgcctaactctcatatagccccaacactaccaggggaccacaataaggctttgggtccctgggtatcaatgccaagatggattctgtgtctagcagcacttgaaatgtttaaattcctctttacctagtatgtggcaactctagtaaatagccataagtgccactggggaagaactgaggaatcatgaccactcactcactgccgtgaaggagttgttcctcctggaaacccagcctctccttcaggcactggggtctggtctgaagtttttcactggggtagctgccctcagcctccatctcccatcttggatttcttttggttgtgtagattaagcaatgactttgtgggctgttctcctccttggccacaggaataacctgctcaattcgccacctccacagctctgggaaggtcggatgtccctggctgccacagcaatgttggcacctctgcttagagagggccatgctttctccaagcctccaggggctacacaggcagcatgttggccccacctcctgggctctttctaggatgttatatcctgtatcttagaagagtgttctcacagcagcctgggcaacatagtgagacccccatctctacaaaaaatagaaaaagttagcccgtgatgctggcacatgcctgtagccccagcaactcaggaggctgaggtggaaggactgctttgaagtcaaggctgcagtgagccatgatcgcaccactgcactccagcctgggcaacagagcaagaccctgtctcaaataaataagtaaataaataaataaaaataaactctactttatccaactttatgttctaccccctccctaccttgtcccaggaccctcaggcctgccacacacacgtgcacacgcacaactctctctgactcgctcttcctagtcaccttggccaagtcctgcagcttctttagaatttggtccctgccctttcttactaagcccaatgcctccccagccaagtgtagtctcaagttcgggtgtgaccaggagcaggtggctggccctgagggtggccattgccttgcaagtcagtggcggctgggcacctgggtgcttcccttcagacgaacccattccaagcttcagggagcctctgtccccacagagggagctaaactgaccaggactgagagttcataattttctctaattatgccctgggctcaattctcagcatttttagccctccagtagcaggaaatagtctctttagctgcagcctcaaggccccgtgaccaacactgtgctatggtgtgattggtggtgaatcatgcttagcctttcactgtctttctctaaccgatggtctcagcagcacccatccaactccaggccttattgacgtccatccccaggacctctcagaaaactgagctatggcatgtggggaaaagcaagagagatcagattgttactgtgtctgtgtagaaagaagtagacataggagattccattttgttctgtgccaagaaaaattcttctgccttgagattctgttaatctataaccttacccccaaccccgtgctctctgaaacatgtgctgtgtcaactcagagttaaatggattaagggcggtgcaagatgtgctttgttaaacagatgcttgaaggcagcatgctccttaagagtcatcaccactccctaatctcaagtacccagggacacaaacactgcggaaggccgcagggacctctgcctaggaaagccaggtattgtccaaggtttctccccatgtgatagtctgaaatatggcctcgtgggaagggaaagacctgactgtcccccagcccgacacccgtaaagggtctgtgctgaggaggattagtaaaagaggaaggaatgcctcttgcagttgagacaagaggaaggcagctgtctcctgcctgtccccgggcaatggaatgtctcggtataaaacccgattgtaatgctccatctactgagatagggaaaaaccgccttagggctggaggtgggacctgcgggcagcaatactgcttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctctttgagaaacacccacgaatgatcaataaatactaagggaacgcagaggctggcgggatcctccatatgctgaacgctggttccccgggtccccttatttctttctctatactttgtctctgtgtctttttctttcctaagtctctcgttccaccttacgagaaacacccaaaggtgtggaggggcaacccacccctacatggcgtccccagtgcacattctcccattctaattcaccaactgtggaggttctaagttctaacaatttcgcctgcttcagcatgccaggggcgtcaacctgccacccaccaccagggttagcgccagcagtgatgtgaagcagctcgcacatcccacgtggagcctgcttcctccacctgccctggaaccaagcccctaggtcaggttctctggaaaactcgaactggtcctgtgcaggcaggagccacccccatggtagagtgaaggagacaggatgccacaacggaggcctcgcccgatccctgggggagctctggtgctgggatggctggtcagggacatcctgccttgaggcaagggaactctgcccttccaggctactggaggtgccaagataccaaaaggaggggcatgaccatgggccgcgggtaattcctgcaggggactcagctgagagccaccagtagccactcttcccagtggctgtgggaccgagtgcctcagtcctgagaggatcttgcccatgggcacagagtgccagagaccttggaaagtccctctgagcacgactcctctgtgcctaaccctgagcagctccagggctccaccctaaactgtgtattgctttggacgtgccagcagttccaaatcctggggggccagccgggcagacagcatctggtgtggagagaacaaagagtgaagctgactgagcacacggtggatttgaactgttgcatgggcgggaggtggggtggatgagacagggaggggtcagggggatgctatggctggagctgaggtgctggacattatgaggggaagaggaggccatgggggaggttttctggtggggaccagacatggctagagcagtgcttgagaaaattccatccaacagaatggatgttaagaggggataattctgcattccctgagctttggctgtaccagtgggggcaaaaaaccactccaacctccaggagtgtcaggagagcgacacaggcacacaagaggcagaaaggcctgtacgaggccaagtgctagctagctgaggtccgaggcagggccacgtggaggggacctgcagggcttcctggctagtgtgtccagggggccctgcccgagggctgtccagtggggaggcgttggcctcatctccaactgtcaggaagggaatgtgactctccaggaggaggagactggcccaaagccacgcagccatgcagcggtggggtcaggacctgcacctgagtcggcactagaaccacctccttaaccaccagtccacactgcccacattgaggtggtcaggaggtcaggaacgaggagcaccaaggagcagccttgacaaaacggcccacagagatgccagggctaggaaccacactgctgcaagaggacagaaggggagatgcacgctgggaacagacactcaggacggaaatgtgtcaagaaggaaagaagaatgcacacggcagcctgaggggctggcagtgtccgacggggcttgttacagaagtggggagagagtccacgccagaggggctggtggggcaggggaggacaatgggcttcagaggggccgtgtgtgtatggaggagagtcataaagacaggaagaaagccaaggggaggagccccacggagaaataagacgggaaattcattcagggtggggtaggagagggtcagggagagagggaggactcctttctgctttggggtagaaacgattagagtggttttgttgttgttgttgttgtagtttttttgagacagagtcttgctctgtcgctcaggctggagtgcagtggcatgatctcgtctcactgcaacctccacctcccaggttcaagtgattctcctgcctcagcctcctgagtagctgggatttacaggcatccaccaccatgcccagctaattttttgtttttttagtagagacagggtttcaccatgttgcccagcctggtctcaaactcctgagctcaggcaacctgcctgcctctgtcccaaaaagtactaggattacaggcgtaagccaccacgcccagcctacgattagagtttttttaagtgctggggtaggaggcagtagacaggagccccggccatgggagaggctggcctggggcattgtgtggggcagtgaaaatgctacgggtagaattaggcgggaaggaagaggagtgtggcagaattccattctaaaacaggatagttagggaaggtttcacaggcaatattagaggaagatgtgaaggtgctgagctatcaagggtgggaaccagtgttaacactctacaggcaggagaggtctggtgctcttggtgcctggtgctatggctggaaaagcaagtgtagctggaacagagtggacaagggcgagaggaagaggaagtgaaggcagagaggggacaacaaacttcacacagggtcgtgggaaatactgtgcagactccgggttggattctgaggcaagttggtgccctcagaaggtttgcagctgaggagggacacgggtggggatgactgagctgctgttgacttggctgacaagtgaatgaggagagcaagtgcgcatgcagggagtccggccaggaggctacggcaggaaccagtgggaatgcaggaagcacggactgtgactcatatttctggaagtacctgcagccttgacaagaagtatttgcttgtgggtggtgtgctgggtgtgagagatgaggcgttcgcaagaatcctggctaggtgaatgggatgactggtttgaaggagatcagtggctgtacgttcagctcaaggtgtctaggagatgtccaggtggagatgttgggggaacaaatgcattagagcctggggttgaggagaaaggcccaggatatgaggagcatttgggaactgtgtgccttcaggaagaagggatgaggtcaccaatggcagtggatgttttagagaaaagttccaaccctgacaatcccggggggcatttcaacattaaaagattgggacagtgatgaggaactagtgaggagaccaagggctggtcagcgaggtaagagaaccatgggacagaggtgctggaggccaataaaaaaatatttcaggccaacggcagtggctcatgcctgtaattccagcactttgggaggccaaggtgggcgaatcacttgaggtcaggagttccagaccagcctggccaacatggtgaaaccctgtctctactaaaaatacaaaaaatcagctgggtgtggtggcacacgcctataatcccagctactcaggaggttgaggcaggagaatcacttgaacccgggaggcggaggttgcaatgagccgagattacaccactgcaccccagcctgcatgacagagcaagactccatctcaaaaaacaaacaatttcagaaagaaatgatcaaccatgatatggtcgggtggaaaaggcaggtggagttggagggaaaggagggagagtgacttagggtgggaggagagaaagtggaaacaatgaaggtggacaactcagcgtgactttgctgttaaggggcacaaagcactgaggtggtcgttgcaaatggaagtggggtcaagagagggttttaggagagaaccgtgctgtatggagggaaagaaggttggcattccccttgacagggatggaagaggccctcaggcctgacaacacacacagggttaaggtgctcccacctacttctggcgtctaaccctcattttttaaatttttttttttttttatatgaggagcatttgggaaccgtgtgccttcaggaagaagggatgaggtcaccaatgggagtggatgttttagagacaatttccaaccctgacaatcccagtgcagtggcccgatctcagctcactgcaacctccgcctcccaggttcaagcgattctcctgcctcggcctcctgagtagctgggattgcaggcgtccgccaccaagtagggctaatttttgtatttttagtagagacaaggtttcaccattttggccaggccaatctcgaactcctgacctcaagtgatccgtccgccttggtctcccaaagtgctgggattacaggcgtgagccatggcgcccagcctttaaatcttttaaaaactaaaaattaaaaaagagaaagagaaaaaatcagcatgtttccccgcggggggcaccgtctccgtacccccgggagacgcgcaggaaggacatcctggagtgaggagactggggagacctgaaggagtggagggcagggagggagggaggctgcgcggacggtggcgcgagcagctcaccgcgtggtgcacaggacgccgggctgggccggagccagaggcaggaaggtgggcagaggctgcagcgggcgagtaggagcgctcctgatggctgctctcaggagaaaccaaggccgagtgtgcagagtcgggcaggaaaacgccttgagagagtggctgacgcaagccagcagagggtgtcagggacagcgtgtgcgggctgccatgcgctcgggtgctgcgcagggtggagtcctggggcttggcccatggagtggtgtcgcgcccagggttaagggggtgcaggcggtgagagcaacggagcccaggctggtccggccctgccaggctaagctcgggggctccccccctgtccccccagtgcctgctgcgctgggcccaggccgcccgtgccctgccaggccctccggccccccaccctccaccccagggcctgctcctcaccccagggttccatctccctagtttccaccagagactgggtacgtgggggcgctggcaaggcgaaggaggaggcctgtttatcgtcaccatggagacggtggcggggtgggtcaccaggcttggtgggcccggggcgaggccggggagaggctgctttgcccccagccctcccttctcctacccccaccccttgtcctgggcccgccaggcccgtgagcccgcttcaggaggagcgcatacccggctccgacctgcagaaccgccaggggatagagtgcggtctgtgataattaacacagaaaattaacacatcttattctagtttatttctgtgctcatgtaaatagtgaatgatttagaatcctaccacagtgtgacagtgtccgctttcacaccctcggctggttctgacgcactcccggcgtaggaagttctggtgggtgccagatggttctgagttaaccttttccagttggtggcactttgtccccgatctcatttcaccctcaggacagtgctgtggaggggtcgctaagagtccgaatcagcaggtgggcactggtaataataccagtaataagaaccaacacaggacagcaggtctgtccagctccaccctctgctacttttttttttttttttttttttttgagacacggtctggctctgtccccgaggctggagtgcagtagtgggatctcagttcactgcaacctccacctcccaggctcaagcgatccttccgcctcagccttctaagtagctgggaccacaggcaggcaccgctgtctaactaatttttgtattctttctagagatagggttccgagatattgcccagtcttaaaccccggactcaagcaatgcgcccctctcggcctccaaagtactgggattacaggcgtgagccaccaaatccggcctattatgtcatttttacagttgccattttcccccaaatgtatagaaaacaatgtgcctcatatttcacaaatgttggtatcttcccagcaccgtgagcagggcactgttcacagtgggtcaggctgagttggtccccgcagcactgattctgttgaccctaatggcagcaagcagagggcagtttattggtgtctggccctctgtgtccctaatagaagcccctgcaagctgcacccttccattccaaggctctgggcctctggaggtggagttctctcagctggccccgggagacagcgcagtggccagagctctggctcatcaggtcagggaaagaaaatcaccctcagaatctctcatctctggccagcgttcttcctggtgactgagtcacaactgtcctgttgtccatgggtgtggtcatggcatagtgcctatgggtggtttttcctctggagtctccccaggactcttgtgacccagaagtgcacatcacacgcgtgctgtgcacaggcccctcgtcctcagtggcaccctgagatcaggcaatgggcaggcgtttataaatgtgcagctgctccaacccggcaccagaatggctgtggtgtgtgtgaggcactgctccttccaagagctttcagatttggggtgaggtgtacagaggaagcagccacctgtcacagaagacagagtagtaaagttaagagaaaagtgtgtccaggcacagtggctcatgcctataatcccagcactttgggaggctaaggcaggaaaatcacctgaagccaggaattcaagaccagcctgggcaccatagtgagaccctgtcactgcaaaaaaaaattttttttaccttagccaggcatggtggtgcatgcctattgtgcagcaactgggcaggctgaagcagaaggatctcttgagcccaggagttttaggctccagtgagctgtgatcacaccactgcactccagcctgggtgacagaacaaagaccctgtctcaaaaaaaattacagaaaggtatagacaaacagctgaggagtgtgagatcccagcagtcaggaggctttcctgagaagggaaaattggccctgggctctggagaagacatggaacttctgatgtgggatggtgaagggtatgggcactgccaaaatcccccctggactcccccagcatcccctctgtccctgcctcctcgctcctcctgctttgaagctgagctggcatttgcttctctgtctcatcactctcttttctttattcaagaaaagctggccgggcacggtggctcatgcctgtaatcccagcactttgggaggccgaggcgggcggatcacaaggtcaggagatcgagaccatcctggccaacatggtgaaaccctgtctctaataaaattacaaaaaaattagccaggcatgtggcaggcacctgtagtcccagctattcaggaggctgaggcaggagaatggcgtgaacccgggaggcggagcttgcaatgagccgagatcgtgccactgcactccagcctgggtgacagtctcaaaaaaaaaaaaaagaaaaaaagagtgttggccaggcgtggtggctcacgcctgtaatcccagcattttgggaggctgaggcaggcagatcacctgaggtcaggagttcgagaccaacctagccaacatagtgaaaccttgtctctactaaaaatacaaaaattagccgggcatggtggtgggtgtctgtagtcccagctactcagggggctgaggcaggagaatcacttgaacccaggaagcagaggttatagtgagtggagatcacgccattgcactccagcttgggtgataagagtaaaactgcatctcaaaaaaaaaaaaaagaggagtcttaggagtaaatttaacaaaataattgcaaaatgtgtactcttaaaaatacaaaacattgttgaaagaaattaaagtgctaaataaataaataaggttgggtgtggtggctcacacctatggttccatctactcaagaggctgaggtgggaggatcacttgagcctgggaggttgaagctgcagtaagccatgatcacactactgcactccagcctgagtgacagaatgagaccttgtctcaaaataaaaaagttaaatgccgggcacagtggctcactcctgtaatcctagcactttgggaagtcgtaggcaggcagatcacctgagatcaggagtttgagaccagactggctaacatggtgaaaccccatctctactgaaaatacaaaaattagccaggcatggtggcagttgcctgtaatcccagttactcaggaagctgaggcaggagaattgcttgaacctgggaggcggagattgcagtgagccaagagtgcgccattgcactccagcctgggtgacagagcaagactttggctgggtgcagtggctcacgcctgtaatcccagcattttgggaggccgaggcgggtagatcacctgaggtcaggagtttgagaccagcctggccaacatgatgaaacctcgtctctactaaaaatacaaaaaaaaattagctgggcatagtgcctgtaatcccagctactcaggaggctgaagcaggagaattgcttgaacccaggaggtagaggttgcagtgagccgagatcgcgccattgcactccagcctgggcaacaagagcagaactctgtctcaaaataataataataaaataaaaataaaaaagttaaaagtatggtgtgtatatatatatacacacacacactcatacaaacacacacacacacacacacatatatgtacatgtatagtatcagccatgaggtcctgccagaagatgacggctcctaatgccacttcccaacacaagagttcagtgcccacatatgcaaggctgagagcctcacaaagagcagggcaaggtacacacatcagtgatataaagcatataggatacaatatatttatacaacatggaggggatttacatgctatctaagcaagaaaggtattacacatctatcttcctacacgtagaaatgtagagtagtttagtaatcaccatgcataaatacatagaatggataactatagtggttacataaatattgaaagaatgatgaaaaaatgtagaatagtgctaaaattaattctaagtggagaaatgatatagatatagatatgcaaatatacacacatatgtctctctgtaaattggtaaagttatacatttgcatatatatatcgcagttggataaatataatgtttaaagggacattatttatagaaatactataaagtatggggcacagtggcctgcactgtagtcccagacttgggaagccaacctgggaggatcgcttgagcctaggagtttgagaccagcctgggcaacataacaagaacttgtctcaagaaaaaaaagaaaggccgggcgcggtggctcacgcttgtaatcccagcactttgggaggccgaggtgggtggatcacgaggtcaggagatcgagaccacggtgaaaccccgtctctactaaaaacacaaaaaaattagccgggcgtggtggcaggcgcctgtagtcccagctactcggagaggctgaggcaggagaatggcgtgaacccgggaggcggagcttgcagtgagccgagactgcgccactgtactccagcctgggtgacagagcgagactccatctcaaaaaaaaaaaaaaaagaaaagaaaaaaaagaaaaaggtaaaaaataccatatattcactttttttttttttttttgagacagagtctcactctgtcacccaggctggagtgcagtggcatgatcttggctcactgcaacctccacctcccgagttcaagcgattcccctgcctcagtctcccaagtagctgggattgcaggtgcccaccaccaagcccagctaatttctgtatttttagtagagacggggtttcaccatgttggccaggctggtctcgaactctggacctcaggtgatccacccgcctcagcctcccaaagtgctgggattacaggcgtgagcaaccgtacctagccacacatttcttgatagataagatacataaagttattcaataaatgtatatccagatacttaatggttagggaagcttagttaaggcacctggacaccaggaaaacatgcttttcccaccaaaagctccagatggtcctgtccggtcctgtccagtcctgtatcaagatgccagtggggaaactgagtgcctgttgaggcaggcacccaggaggcagcacagccagtgaggagaagggaagggatatacaggaatgtgaagtttatggtattcgaggtgcactgagcacgctgtgtacgaagggctggcctaagccctgcaggggcattattcatctcatcttctctaccctgagatggatgataccatcatccccaagttatagtagaggaaaccagggcccaacaaagaaaagctgccacaccagcaactttataaatctttacaatgatgtgagaatttgtgggctagccagatttttaaagaaaacttcaagtttgagcaaatttgcagacactcaaaatctactctccctaacctggaagtgtctctgcaaaaataaaaacaaataaaaagtaaaatgtcatgacaattagtggactagtccggatttttaaagaaaacttcaggcttgagcaaacttgcagacacccaaaatctacttcctgtatcctgagagtctgcaccagggagagcagtggggagggtggaactgatgccgaactgtcctagaccgcccccttctggccagaggaggtgggctcagctgtctccatgaacaaaaaccgccctctcttggctagaggcagaggccagtcctcaataagggccctgtgtgtgtgtgacaagatgcactaaccactcgcttcgtgcctagtggggctgtggccagggtggggcgttgctggcttggcctggagaggggacacaaagggacacatctgaagccacagaaatttcagaaacaagcaaatgcagggtcactgggagacacctggacactgcaaagatgcagagataaagaaggaaacaacagttcagcagagggagagagagagatggagcaaggacagggagagagacacccagagagagatagagagactctcccagacaataccaaccaagccagagagatgcggaaggactgagatacacagaagccgtccccgccccggccctgcaccccaagacatggtggaaaatgaagcatcttctctgacctgagctgagacaggcagggagcccctagcaggaagagctcttcccttccccatcatgtggtgtctagacagtcttcccgccccagcccaacacccgatttcagaagctcccaggagctctgcatcctagtcctccgggatttgttggtacaaatgggcttgctgtgggtctttccccaggatgggctaggactctgtctgtggcagcaggcccagtttcccagcttcctaaattccactgccatgtctctttgcctgtctcattctcctggtgagtatgcttgccttttcacacaaaaaatggaggtttcctcccaaccagctctgtcccactgaggctgataaagaactgtgaacctggctgggcatggtggctcactcctgtaattccagcactttgggaggccgaggtgggtggatcacttgagatcaggagttcgagaccagcctggccaacatggtgaaaccccgtttctactaaaaatacaaaaaatagccgggcgtggtggctcacacctgtagtcccagctactcgggaggctgaggcaggagaatcgcttgaaaccgggaggcagaggttgcagtgagctgagatggcgccactgcactccagcctgggtgacagagcgagactgtctcaaacaaaaacaaaaacaaaaacaaaaaactgtgaactttgctgggcatgatggctcacacccctaatcccaacactgagaggctgagatagggggatcacttgaggccaaaagtttgaggccaggttgggcaacaaagtgagaccctgtctctgtaaaaatacaaattaaagaactgtgacttggagatgccagtgactcttcctgggctttgatgaagaccccttcctggctgaggaacagaacctgtcccaacctgcctggaccagccctggggcctcatctggcccccacccagtggccaaggctttattatcagaaccaggactgcctcctcatgagtgcagcctcctgaagatggctgggaagtccatcagttgaaggcctggggaaggaggagatgtgaactcctcctcagtcaggagatgacatttacctgcaatcttcctcttatcttcccccacccgtaggccacattcagcattcttcaacaaacactctgttgcctgtgcccagagacccagatgctggaacctgaccgcccggatctaattctagtcccaccacttaccagctggctgacttggcaggcaacttcacctgttgtgcttccgttttccatagataagatggaatctggctaacatcaacgtcactgagcaggctgggtgcagcaactcacgcctgtaattccagcactttgggaggctgaggaggtgggaggatcacttgagccaaggaatttgagtccagcctgggtaacatagcaagacaccccccaataaagaatcgagcctgcccagcctatgggtgctgattgctccaaacaatccctgcattcccccataaagtccaggctgcccgaaccatggccagtaatactggagaacaacccctccaaccgagctgcccaaactggctgccaatccgcaagaacggccccttatccagcctgcacccccaccctctccatggctgctaatcctggaaacaatccctctattcccacttcagaagctggctgcgcctcccccatgagacacctctgcgccctccccgaatgagccgcacgtctgcttctccaaacggccgctgtgcccggtgctcagcgcatctcaactcgcggcaggccgccccgcgagccgcctctccctttcctgcggctcgaagggaccccagcgtgaaccgtgtgcttgtttttcattgtctccatctcggggcttccttgtagagtttggagctccgcgtgaacagcgctctacgcgctagttccatcggctcctcggtgcccgcacgcagccgcgcgtgccagtcagtgcctgggtcaccgcgaattccatcccaacccgctccggcaccgcgacggtctctcctgtcactggagacgtttcttgtgtcagtgcaaatatatgtcgttccttgtttttttctattaaagacagtgcttggtgggaacatttctgcactactggagtttctgaagcttcaaccccacgcaccaggcccacccacacccgggcccccgttcccccgcccgacccacccacaaccagccacctagctcagatcccggcccatgatctgcaccccacgcccgccccacactcaaaaccgctccccaaggccgcctaagcccgcaccccatggcctgagtctcctcccacacccggctttccccgtgcccagcaacttctgcaatgcccgatcccccagtatcctggccccctgcattccagacccccacaccctctagccatcgtcccccacgtcccggccccaccccatgtctgactctcccacgcccagggcctccctcacagctttccctgtcacactttggtcaccttcccacacccagacccctgcccagcgctgggcccaccctagttccaggccccctccacaccccccaaacctcccctacccacacacacccaggggctctgccaaggctcttgggggtttggtggcagcaatgtagttaatgagcatcctcaattcaaagaatgttcaagactgcactgcactggagaacgtgagagccctgaaatcttgctgctcctatgtgaaaaacacttgaaagaggttttcccaaatttgacaatatccaaaactttcacattagcaatggggagcatatattcagggcaactggtatggggggaaatgttagcaataataagtggtgaactggaatgcacattttctaagctattagtaaaaaaaatttaagagagggagtcggctgggcatggtggctcatgcctgaaatcacagcactttgggaggccgaggcgggtggatcacctgaggtctggagttccagaccagcctggccaacatagtgaaaccctgtctctactaaaaatacaaaaaaaaaaaaaaaaaaaatcagctgggtgtggtggcgggcgcttgtaatcccagctactcgggaggctgaggtaggagaactgcttgaacccaggaggcggaggctgcagtgagccgagattgcgccattgcactctaccctgggcaacaaaagtgaaactccacttcaaaaaaaaaaaagagagggggtcaatcacaccagaagacccgtttatccttcattctttctcaaagaaattgttataatattctaaatcattatcatatgaagcagtgatcatgattatgcagttactggtagcagcaaaatgtaattatgagggaattaattttaaaatttatcttttggaattttgttatgctatgcttttgaaaatttgcagttgttttgcttttgtcattctaaaatcattcttttatcattataaataaatacaaactttgagacaaactgattatattcagaattctgtgctcttttcttttttctttagagatagagtctcactctgtagcccaggctgtagtgcagtggcgccatctcggctcgctgcaacctctgcctcctgggttcaagtgattcttgtgcctcagcctcctgcttacaggtgtgcgccaccatgtccggttaattttttttttattttttcgagatggagtctctgtccatcttttgagccgagattgcagtggtgcaatctcagctcactgcaacctctgcctcccgggttcaagcagttctcctgcctcagcctcctgagtaactgggattacagctgcgtgctgcccggttaatttttgtatttttagtacagacggggtttcaccatgttggccaggctggtcttgaactcctgacctcaggtgatccgcccgcctatggcctcccaaagtgctgggattacaggtgtgagctactgtgcccgcccggcctaatcttgtgttcttttcttagagataactctacctatggtgccaacttcagctcccactttcagatctgccctcctcctctaggggcaggtgtgtccggtcctggggcatccctgctgagcaccacgtgtgcacaacttcagctttcagagacaatgttgattgttttctaaggcaggtgtgccaatttaggactggaaatgagtcccatgcacccccagtctgcccaaacccaggaacctagaggggtcctaatcacctgtgtcagtgaaaaggtggaaaatagcaaactctacccatccctcagagcaaaatggtttctccaattcctctgtggtgcaggctataaattcagaccctcagtgtggaaaatcccaatgttgatcattagaagttaatatattaaaatattttaccagtttattaagaacttagaggcaaataatagctctcaagaatttatacatcaaaccacaagacattttaattttacattatagaaaaaacctggtgctctatttttaaaaacatgattggatttttttccccattgtttactaaatttcgacttcttcaatagttctttctggtttggtaaacattgctctgagtcacttctccttctcttttgtagtctgatcataggagagcacactaccagctccctttgtttactggggaggccaaataacaaatggttggtattttatattagctactgctgtggagacaacaaatacatgtggagctctgattgcatttgaatctaggtttcaggtggccacaaattcaataatttctttaacttatttaacagacaagcctctacaaactactgacattcatggtcacattctatgccaacaaacacagaaccaagacctttccaaatcgtagtgtcgtgggattctttcaactttaacattcagtgccagtaaaaacattcttttattctactcctaccaagtaaataagtgattccccttatcagatgcttaatctcatcataactaacttatttttataaagatttagataaaggagttcagtggagagacatttattggaatgaaccactggtttgagataagaaacccttttcataaattatgccttaatctaaaatctgggtaagtattttacttcattggctcagtttaactggaggaaatagcaaagagaaatttatgactatggcttataaatatttaaaacctgtttcttcagaaacagtgatcaaggattactgagaaaaaaaaaaagaaaacctgtttctctcactgactgactctgacctctgagaaagctgtctctctgccccagcactctgcctcacagcctgctttatgaatcttcactacacccgtcagtcaacactgggaagataacacatctatttcttcctcccactctaagcccactgtgatatcatccattggaggcaggagctctgcgctgtccctttgcagcccctggaactgcagtgagctgtgtgtattgagtcaatccataaataccaagtaattatataaataaaaattataggagacccttgttttggactaagctcctgctaggatcagcttagtcctaaacaagggtctcctgggtggatcacctgagttcgagaccagcctgaccaacatggagaaaccgtttctactaaaaatacaaaaagaattagccaggcgtggtggcacatgcctgtaatcccagctactcaggaggctgaggcaggagaatcgcttgaacccgggaggcagaggttgcactccagcctgggcaacaaaagcaaaacttgaaactctgcctcaaaaaaaaaaaaagaaaaagaaaaagaaacaaacaaaaaaaaaacacaggggtctcctataatttttatctaacataactttcaaagcattttcattctaatacaattactccaaaacagagtcacctctggccttccatcaggagagagataacagtccaacttcccaaacaggccagcttcagtggcatgataatgaagttccctctgcctttaatccttacaacaaaaagggacccgaggttagtcaatcagttcttttttctattgttctgtctcattcttgccttaggaggaaagcaaccttaaaacgaccaattcactttttcttttttgtttctgctttctttagccattttggtctataaaaccaacctcctctgctcagttccctggaacatttattccattttatgaaaggaagtgttgccttatttgagaatcacaaagccaactaagaatttttaaatgggccaggcacagtggctcactcctgtaatcccagcactttgggagaccaaggcgggtggatcacctgaggtcgggagttcaaggccagcctgacaaatatggagaaatcccgtctttactaaaaatacaaaattagccaggcgtggtggcacatgcctgtcatcccagctactcaggaggctgaggcaggagaatagcttaaacccaggaggcggaggttgcagtgagccgagatcacatcactgcactccagcctcagcaacaagagcgaaactccttctcaaaaaaaaaaaaaaaaaaaaaaaaaggagccaggcacagtggctgatgcctgtaatcccagcactttgggaggctgaggcaggtggcccagtctccactaaaaataccaaaattaaccgggcatagtcacacacaaaccctgttggctaggctggtcttgcactcctgacctcaagtaatctgggccaacactgtaactgcccaaggggttcaccttgcccactgcgtagacagagccaattcatcaagacaaggaactgcaatagagaaaaagtaattcatgcaaagccagctgtgtgggtggctggagttttatcattactcaaatcagtctccctgagcattcggggatcagagtttttaaggataacttggtgggtagagggggagccagtgagccaggagtgctgattggtcagagatgaaatcatagggagtagaagctgtcttctagcactgagtcagttcctgggtgtggaacacaatgtcagacaagccagtttattgatctgggtggtgccagctgatccacaagtgcaggtctgtaaaatatctcaagcactgatcttagcagcagtttagggagggtcagaatcttgtagcctccagctgcatgactcctaaaccattatttctaattctgtggctaatgttagcctagtccccaggcaagaaggaagtctgctttgagaaagggctgttaccatctttgtttaaactataaacggcaagcaatcctggcgaggtggctcacctcccagcactttagggggcaggtggattacctgaggtcatgagtttgagaccagcctgaccaacatggtgaaacccccgtctctactaaaaatacaaaaaaattagctgggtgtggtggtgggcgcctgtaatcccatctactccggaagttaaggcaggagaatcccttgagcccaggaggcagaggttgtggtgagctgagatctcacctaggtcctgccactgaactccagcctgggcaaaagaacgaaacttcatctcaataaataaataaataaacaaacaaactacaaactaagtttttcccaaagttagttcagcccacatccaggaatgaacaaaggcagcttggcagttagaagcaagaagtagtcggttaagttagatctctttcactgtctcagtcataattttgcctaggcagtttcaacatggtgaaaccccatctctactaaaaatgcaaaaattaggctgggcacagtggcttacacctgtaatcccagcactttgggaggccgaggaccaaagtggatcacctgaggtcaggagttcaagaccagcctggccaacatggtgagaccccctctctactaaaaatacaaattagcctggcatgatggcaggcgccagtaatcccagctactcgggaggctgaggtgggagaactgattgaacccaggaggtggaggttgcagtgagtcgagatcgcaccattgcactccagcctgggcgactaagcaaaactccatctcaaaaaaaaattagctggctgggtgcggtggctcatgcctgtaatcccagcactctgggaggctgaggcgggcggatcacgagatcaggacatcaagaccatccaggctaacacagtgaaacccaacacaaaaacaaaatcagccgggcgtggtggtaggtgcctgtagtcccagctactcaggaggctgaggcaggagaatggcgtgaacctgggaggcggaggttgcagtgagccgagattgtgccactgcactccagcctgggcgacagagcgagactccgtctcaaaaaaaaaaaaaaaaaaaaaaattagctgggcgtggtggtacatacctgtagtcccagctactcaggagactaaggtgggaggatgagttccaaaggcagaagttgcagtgagctgagactgcaccactgtactccagcctgggtgacagagtgagattctgtattaaaaaaagaaaatggggccaggtgcggtggctcatgcctgtaattccagcattttgggaggccgaggcaggagatccacctgaggtcaggagttcgagaccagcctgaccaacatggagaaaccccatctctactaaaaatacacaattagccgggcatggtggctcacgcctgtaatctcagcactttgggaggccgagacgggtggatcacgaggtcaggagatcgagaccatggtgaaaccccgtctctcctaaaaatacaaaaacttagccgggcacagtggcgggcgcctgtagtcccagctactcgggaggctgaggcaggagaatcgcttgaaccgggaggcggaggttgtggttgcggtgagccgagataacgcccttgcactccagcctgggcaactgagcaaaactccgtctcaaaaaagaaaaaaagaaagaaaatgggcccaccgcagtggttcatgcctgtaatcccagcactttgggaggctaaggctggccgagcacttgaggtcaggagttcaagaccagcagcctggccaacacagtgaaaccccatctctactaaaaatacaaaaattagccaggcgtggtggtggactcctgtaattccaagataagggaggctgaggcaggataatcacttgaacctaggaagaagagtttacactgaactgagatcgtgccactgtactccagcctgggcaacacagcaagactctgtttcaaaaaaaaaaaaataatgcttgggaccagagatatttctgattgtggaattttttggattttggaatatttgcatatacataatgagatatcttgggaatgggacccacgtctaaataatttatgtttcatatataccttatacacatagcctgaagatgattttatatatttctttttttttttttttttttttgagacggagactccttctgtcgcccaggaggagtgcagtggcgcaatctcggcttactgcaagctccacctcccgggttcacgctgatctcctgcttcagcctcccgagtagctgggactacaggggcccaccaccatgcccggctaattttgtttttgcatttttagtagagacggggtttcaccgtgttagctaggatggtctcgatttcctgacctcgtgatctgccctcctcggcctcccaaagtgctgggattataggtgtgagccaccgcatccagcagatcttatatatttcaaataattttgtgtatgaaacaaagttttgacttttcaatatggcctgtcacatgaggccaggtgtggaattttctacctgtggcgtcatgctggtgctcaaaaagttttggattttggagcatttttggatttcagattttttttttttttttttttttgagacagggtttcactctgttacctaggctggagtgcagtggcacaattacagctcaatgaagcctgatctgctgggttcaagggatcctctcacctcagcctttcgactagctgggaccacaggtgtgcaccaacacacctggctaatttttatattttttgtagggatggggtttcaccatgttgcccaggctggtctcaaactcctgagctgaagggatccacccaccttgacctcccaaagtgctgggattacaggtgtgagccactacacccagacaaattttggatttttggattaggtatgctcaacctgtatgttgaaaacaaggtgccagggaacaggctctcagtgactgcaggcatcaggtgatgtgccagggagacacagaaaggaagaggagtgtttcaacatgtggccagtaaaagacttccaagaatggccgggtgcggtggctcacgcctgtaatcccagcactttgggaggcccagatgggcacattggctgaagtcaggagtttgagaccagtctggccaacatcgtgaaaccccatctctacaaaaaatacaaaaaaattagccggacatggtgatgttcggctattcaggaggctgaagcaaggcaggggaattgcttgagccagggaggtggaggttgtagtcagccgagatcgcaccactgtactccagcctgggcgacagagcaagactcagtctcaaaaatagaagacttccaagaataaaaatatattacttaggttaagttcggtgggtgacagaggaaggaaatagactcaactcaggccaaaaaaaaaaaaaaggaggcggcaatatggagtaactaatattaaacaagagttaagtaaatcttcaaatggagatttggaataaaaatagtatggtgcaacaagagcgaaactccatctcaaaaaaaaatggtatgtatggtgttcagattccactagatatattacaactcatgtagccattttactttaaaatataaatattaaaacataccagaaattgtatcttttgcaactatttgagcttatgatgagaaactttagcaacataaaactgtggaatggatatgtggtttttcagaaatgagagcaaacattcaaagactactctattacataaatacgggaatagaagagtggcccagaaacgaaatagcaggagcttctagggttcagcaagagagggctgagggagactgcccaagaagggattgaagcggggcctagaatgccaaagcttgtactgcactttacgtgtgtcacaggaggacagaaaggggtgagtcacagagctgtttaggaggcagaatggacaagaattgtttgattggttatggggatttggaggcaaataaagtctaggatgatgctcaggccttcggctttaccacttggatggagcacagagagtaggcggggtggtttaaagaagaaaccaagtatttatttcaggaaatgtcaagtttcagcaaactatgagacatgcatgtggagacaggaggcaggcagtgggcctggtggtctccagctaaggagagaggtcagagaggtgagtttccaggagggagcagccaaatctcagagcctgctgagggggttaagacctaattatccatccaaaagtgtatccatccacccaaatattactcagttattttatttatttttgagacagagtctcgctctgtcgccaggctggagtgcagtggcgcgatctcagctaactgcaacctccgcctcccgggttcaagcagttctcctgcctcagcctcccgaggagctgggattacaggtgcgccaccacgcccagctagtttttgtatttttagtagagacggggtttcaccatgttggccaggatggtctcggtctcttgacctcatgatccaccagcctcagcctcccaaagtgctgggattacaggcgtgagccaccgcgcccggccaatttatttatttttattgagacggggtcttgtcattttgcccaggctggtctcgaagtcctgggttcaagggatccacctgcctaggcctcccagtgctgggattacaggcgtgagccatggcgccctttctactcaagtgatttatcaatcattttactcaatagttaattcacacatccatccagttcccacaatgaattccatccatgtgccaaggtctctgggacaggaagctgagtgacctgaaatcacagccctgggagaaaagggaggtgagtggtcaagacagatacacccatacctgtgatgtggggtttgggaaaggtgggcctcccagaggggaggcaggtgaacaggaaaggtggcttcccaggtgaggcaattgttgaattggacagagtggaaatggctcacagtggtccttgggagaggatgagaattaggatggagagaaaagattgaatacgtgagatatggaagaactagaaggatgggctctcactgggggggcgggggggacagggaaccgagttgcctaacttccctttggtggagtcagactgtatgctgagcgctgtgactttggaccactgtccatgtccttgagggggtcatatcctgaggagctggcacacatttcagcagatatctccatatgactgggtttagtggtggcctgtgggaccacgtgggaaagagacccacctgagatgggaaattctgaaaggtcagagatggtgggggaacggaaaagtttaacagttgttgactgtgaagtgcctgcaggaaatgaaagggaggtgcccaagagctaagaagtctggtataggagaagcatgagtaggagctgcaacagggggctaagaggtgacctgtgcagtagaaggaaagcactcgcgttctcccaggtgcggaacgagcaaacgttgatgacaaatgactttgcctaccatcttgaaccctttcggcttctcttcttgcacaggtcttcattctcaccctgctacacagcccctaccagaacgttctgaaatgcaaacctaacaactgtctcaccccagcaggaaactccccagggtcccgggccccctgcggggttgcaggcctcactcttcgcgcccatccctccgccctgaccgccctgagctcgcccccagtgctggcccttcacgtccagttatccctcccagcctccaaggtccccgttaccgaagaccgccaccatcacgacatagcgcagcacatatgggtaaacaaatggactgagactcaagcaaagaagtaacccgagacgcgcgttacacggaaaacgactgcgcaagcgcggtagagcaggggcttgcaggtgagtgggagcagccaatccacgcgaagggggtcgggaccacttccgcggaggaaagccccgcccacacctcctgggccctcgcctcactggcggtttctcccgcgagccagcctcatagacattccttggtgctgattggctggcggccagcgcagtcctccttcctctggctctctcgcggccccttgcgggaaggcctcccagaggccgtggggtcgtttctggcggcctaagtgggcctaacttttagagtcccgagggtcgtcgctgccggggagatctccgccccatttccgtgccgccttgtcctcagggcccaaagccccctgcgctaagggccctgtcccatctctgccctacacgcgggagtcagcctaaggcggagccctaggacagcagccgcgcctgacgctgctcgcctgcctagcacaggcagggggtgagcggagtcggctgcctccctccccagggccctccaagggagtgggctccacatccatgggcccgaggaatctgcggagagacgggaagagcaggggacactcacagggcgggggtccaggcgggagtccagtagtcctcgtggagacagctgggaaaggcctcggggcaagggacctcggatttcctcctctgcctcaaaacagacagtctaagctgggtgcggtagcttgcgcctgtaatcccagcactttgggaggacgagttgggtggaccaccaagtcaagagatggagaaccatcctggccaacatggtgaaaccccatctctactaaaaattagccgggcgtggtggcgcgcgcctgtagcccctgctacttgggaggctgaggcaggagaatcgcttgaacctgggaggcagaagttgcagtgagccgagattgcgcctctgcactccagcctgacaacaacagagcaagactccgtctcaaaaaaaaaaaaaaaaaaaatgaccacgcacaggcagcaaggggcagggggtggtccacgctcagccttcagtacacatttgtggaattaatccctcccaggacaggttgtgaagaaagcttgttaacctcaagattcagaagcaccgttcacagcacaagctttggagtcaaattcaggctgttaacttgctgcgtgcgcccccgacttacctctttctgcctgtttgctcatccgtaaaatgggaactgtgactgagtctactttgaatctgattatgctgcatgaactcagaagacagggctcagttgagtgactgctcagtttacaagagctgttactgtagttgggaagcgccctgagacatacatggtaagattggtaacctaggataaagggggccaccatgagagagaccccagagggaaactgttccagagaagagaaatgtcttgctaaggtcacactgccctggtagcgagcacagggcagcctgctccgcccaagtttccagccttctcagctgagttctggcccatcaggctaagccggagactaagcctcaagaaagcaggcattcgtaggaaaggggtcctgtaagtcccaaaagccacctttgctttggaaggtctccaaaaggaacctcagatgcacttctccagaaggccctagcatttttgcctgcccccatccccaccccgcaacaacttctgccctcttcagggatccaccattcctattcctattgctgtgaggtattataacctttaacaggtggaaagaaaacttcacctcagccaggtggtattgatacccatccaaggcaggggacaagttgaggcttggacagatccagagattgggaatccaggtctttgagtgtaccttctgcaagcacaatggtacatcacctcatccacggtgtgtaccatgccttagcactgtgtgccctctgagaggcccccaatttctggccacacactcaatctgcagcaacaccttttacactggaagtgatgcaaagtcagtccctgggttaatgaacatatcttcttaggtattaaacccagtatttataaataaatgaccacagaatggtgtagaaaactttaaaagttttggatattaagtgttggctgggccaggcgcggtggcttacgccagcactttgggatgccaaggcgggcggatcacttgaggtcaggagttcaagaccagcctggccaacatgatgaaaccctgttgtctctactaaaaatacaaaaattagtcaggcatgctggcacgtgcctgtaatcccagctacttgggagactgaggcaggagaattgcttgaacccgggaggcagaggttgcagtgagccgagatcgcacccattgcactccagcctgggcaaagaagagaaactctgtctcaaaaaaaaaaaaagtgttggctgggggtgttgactcacacctgtaatcccaacactttaggaggccaaggtgagagaatcacttgagcctggaaggtggaggctgcaatgagccgtgattgtgccactgcacaacagcttgggtgacagagtgaaaccctgtctcaaaaaaaaaagtgttttttcatccattaggagtgtttggatgaactctctcatggtgtgattcctgagggttggactggcaatgaaggctgtgttcaggaagtttcttgccctgcttcctggacatgcgtttcttaccaaaactcctggagcgatgcattggaatcggacttcttatatagtacaaatatgggaaagctgggtgagaggcactgaaacctacaggaaatcaaaccttgggtgatgagactggaagggtaaaggaaaaacaacaccactttgcctgagcctcagctgggtgggtgcaggtcaaagttcggaggtatcaagacgtttcaaagagaaaattacaggatccagcttcagcttatcttctctctctggctccagcactgcaaagtatacaaaggacctggtgcagaggaagggaagtctgtggtccagagtggcacctgaagatgagcatttcgcaactgggactcctccctgccacctggcctcccctactcaatgagcttttccctgttgctctatgaagaacatagatgtgtccatgaaggtattaatttccctgaggaaaggtaataaagactggaatgtacccagatataaaataaaagggaagtggcaagtatcttacctggcacacagtgggaacataacctgagatttctattttccaagatggactgaacgtcacaggcatcagtagaaggctgagatggtctattttgaggagtgctgtacgtgttcgcgtgtgtgtgtgcacgtgcacacccatacacacacacacacacagactgagattttaaaagacccagtaaagccacacccagtggctcgtgcctgtcatcctagcactttgggaggctgagttgggaggatcacttaagaccacgagttcaagaccagcctgggcaacatagggaggccccgattctacaaaaatttaaaatattgattgggtatgttggtgcatgcctgcagtcccagctacttgggaggctgaggtgagatgattacttgagcctggcagcgggtcaaggttacagtgaaccatgatagcaccactacacaccagcctaggtgacagcaagaccttgtctcaaaaaaaaaaaaaaaaaaaaaaaggccaggtgcagtggctcacacctgtaatcccagcactgtgggaggccaaggcgggtggatcacaaggtcaggagtttgagaccagccttgccaatatggtgaaaccccatctctactaaaaatacaaaaattagccaggagtggttgtaggtgcctgtagtcccagctacttgggagggtgaggcaggagaatcgcttgaacccgagacgaggaggttgcagtgagccgagatcacaccattgcactccagcctgggtgacagagtgagactccgtctcaaaaaataaaaaataaaaaaaaagacctgggagacccagacagaaagtgggagaaaatataccctgctgcagtgacaccaccctcagagaaaccacgatggcaagggagctggctcaggacattgagtcctcaaaacaatgctttcactagtctcctttaataaatgaagaaaccgagacccaaggaggtagaaaccttctccaatgtcacctggcttgggagatgggccccaagtttaaactctgctcagttactgcagagccactacattctatttcctgcatagagaatggctgggggacacatgcccagagaccagcagagagagagtgggaggcagaggccaggaaacacagggtcaggcaggccaagatctgccctccaggagaccatggcacccagagaggccacaccataaaaagcacagcaaggctgggtgcagtagctcatgcctgtaatcccagcactttcgggtggatcacctgaggtcaggagtttgagaccagcctgaccaatatggtgaaacccagtctctaccaaaattacaaaaattaacctggcatggtggcatgcgcctgtagtcccagctactctggaggccgaggcaggagaatcgcttgaacccgggaagcggaggtttcagtgagtcaagatcatgccactgcactctagcctgggcaacagagcgagactccatctcaaaaaaaaaaaaaaaaaaaaaaaagcacagtgaggcggctgccctaggcagtgagggtgtcgccatccagccaccaggctggggtcctgacctcaccatccaccctacatgtgacatggggcaagtcactcaacctttctcttcctcagttttctcacccttaaagtggggattgtgaaaataaagtttacaacacctaaaacactttaagctttaagagagatgtgactatgatctgaatcacataacatttcacaagtctgcttcttctttttttgagacggagtctcgctctgttgctcaggctggagtgcagtggcgcgatctcagctcactgcaagctccgcctcctgggttcacgctgttctcctgcctcagcctcccgagtagctgggactacaggcgcccgccaccacgcccggctaattttttgtatttttagtggagacggggtttcaccgtgttagccaggatagtctcaatctcctgactatatatatatatatatctcatcccatatatatatatatctcatcccatatatatatatatatacacacacacacgcacgcacacacacacagggtttcaccctgtcactcaggctggagtgcagtggcgagatctcagctcactgcagcctctgcttcctaggctcaagctatcctcctgcctcagcctcccaagtagctgggaccacaggtgtgcaccaccacgcctggctaattttttctatttttggtagagatagggtttcaccatgttgtccaggctgattccatatgttttaatttaaaaaatgaataaattggctgagaggagtggctcaccactataattccagcactttgggagtccaaggcaagagaccaagagttcaagatcagcctgggcaacatagtgagacctagccttcactttttttttttttgagacggagtctcgcactgttccctggactggagtgcaatggctgatctcggctcactgcaacctccacccactggcttcaagtgattctcctgcctcagccttccgaatagctgggattacgggctcccgccaccatgcccagctaattttttgtattttttagtagagacgggatttcagtatgttggccaggctggtctcaaactcctgacctcgtgatcctcccacctcggcctcccaatgtgctgggattacaggcgtgagctaccacccccagcctgactcagccttcattttatatacaaatatttaaattttaaataaataaagtgttaaatagaacttcctcctaaagaaagactacctcaactgatcagatcattttttttttgagatggagtttcactcttgttgcccaggctggagtgcaatggcgcaatcttggctcactgcaacctctgcctcctaggttcgagcaattctcctgcttcagcctcccaagtagctgggattacaggcatgcgccaccacgcccggcgaattttgtgtttttagtagagatggggtttctccatgttggtcaggctgatctcgaactcccgacctcaggtgatccacctgcctcggcctcctaaagtgctaggattacagacgtgagccaccacactcggcccagatcattataactatgcattaaaccttaaattttaaaagttaaaattcagccagcggcagtgggtggctcacatctgtaatcccaacactttaggcagccaagggaagtgaatcactagagcccagaagtttgagaccagcctgggcaacatggcaaaactgtctctaccaaaaaaaatacaaaaattagcctggcgtggtggcgtgcacttgtagtcccagctacgcaggagggtgaggcaggagaattgcttgttccagaaggtcgaggctgcagagagccatgactgtatcattgcacttcagcctgggcgacagagggagaccctgtctcaaaaaagattaaaaaaacagctaaaatcctgttaaacgttcctaaactgtgtctatataaacgatcccaggccaggcacggtggctcatgcctgtaatcccagcactttcggagtccgaggcaggtggatcacttgaggtcaggagtttgagaccagcctggtcaaagtagtgaaacactgtctctactaaaaatagaaaaaattagctgggcatggaggctcgggcctgtaatctcagctactcaggaggctgaggcacaagaatcacttgaacccaaaaggcggaggttatagtgagcagagatcgtgccactgcactctagcttgggcaacagaatgactctgtctcaacagaatgagactctgtctcaaaaaaataaaaataaaataaatgatcccaaacttctacattttacgtatttattgtgagacaggtctccctctgtcacccaggctggagtgcagtggtgctttctgggctcacagcagccttgacctcccatgctgaagcgatcctcccacctctgctggagtataggtgtgtgccaccacgccaggctgtttgttctatttttttttgtagagatggggtctcgctatgttgcccagactggtctcaaactcctgggctcaagtgatctgcccaccttggcctcccagagtgtcaggatttaacccccacactccaccgagactttaaaactctgacttccattcttctctttttttcttttttaagatggagtctcgctctgtcgctgaggctggagtgcggtggcacgatctcagcttactgcaacctccgcctcccaggttcaagcgattctcctgcctcagtttcccaagtagctgggactacaggagcgcgccaccacgcccggctaatttttgtatttttagtagagacggggtttcaccttgttggccaggctggtcttgaactcctgatctcatgttctgccctcctcagcctcccaaagtgctgggatcacaaccgtgagccaccgcccccagccatgacttccattctttaccatccttacttcctgagcaggccatccttaacctttacacttaaataaactcctttaaactaaaatctaacctgtttgactattgtagattgacaggctaatgagagtatgaacctccaaagacttctgtgagggctaggtgcagtcatatatgcaatgaactcaagtaaacagctggctgaggaaacaccgggacgcctcctctgtgctaagccccatgcagcatgcacacagacacaggcccacctcagcctcccaaagtgctggggttacaggcgtgagccgcctttcccaaccaatattttatatttttacacaagtgacagcatcctattcagactgccctatactttttttccacttaaaagtatgtctgggccagacatagtgtctcacacctgtaatcccagcattttgggaggccgaggcagtggatcgcctgaggtcaggagctcgagaccagcctgctcaacatagcgaaatcccatctctactaaaaatacaaaaattagctgggcacagtggtgtgtgccggtaatcccagctactcgggaggctgagacagaattgcttgaacctgggaggtggaggttgtggtgtgccaagatcgagccactgcactccagcttgggcgacagagcgaaattccagctcaaaaataaatatataaataaacaaacaaaccaactaaaccatcattgccctccccagccctcccagcccagagacccccatcccttgtcagccatccccccttaccttctggacagggacaagtgtccctcatttggaaaagaattaaggaggggtaacagcagactagggaggcctggggtcctccacacgcctgtgtggggtgactttggcccccagcaacaaggcaggcctgaggtctgcagagggaggcagcccactcctcagccgggggcgtctatcctcctcctggccccatccctcacctgtgggggaggctaagtgggtgtcagggccctgtcagagggtgagccacccccgggggtgcccatcggccaccagcctcccttcagtagacacccagcccaagtgacagcagtggcatggcactgctgagcacagggagcctcaaggtcagtgcctggctcctggtatcctccgtggtccccaggacacccccacacagaggtcccagaacccccaaagctggcacaagagcccaggaacaccctgcccagcaccctccaggtccctcttttaggatctgggtgagctaaagaagccaaaagaaaggctgggcgcggtggctcacgcttgtaatcctagcactttgggaggccgaggtgggcggattgcctgagctcaggagttggagaccagcctgggcaacacattgaaaccccatctctactaaaatacaaaaaaaattagccaggtgtggtggcgtgcacctgtagtcccagctactcgggagcctgaggcaggggaattgcttgaacccaggaggcagaggttgcagtgagctgagattgcatcactgcactccagcccgggtgacagagtgagactccatctcaaaaaaagaaaaaaaaaaaaaaaaaaaaaaaaaaaagaagccaaaagagggtcttcggcccagcccgcccctccccaacagccctgggtgtggcagggagcctgaccagttccctccagcctgcgtcatggagccctgggcgtggctgcagggtttaaagagccgacccacgtgcccagcagcctcctcagatccgttctctgcgctgccagctcaggtgagccctcgccaaggtgacctcgcaggtgagcaggcgtccactttggggctgctgggtgaagggggtgggtgcccaagaattctgagtaatgaggagcctgttgaggggtctgaggacagatatggctgcagcagccgcttgaaggcctcctgctttgcacccactatcatatggatggtgggttgggggttggaggaaacagaagccagcccttggctaaagaatatatgagctggtggggtatacctctggtcccaactgcttgagatactcaggtgaggagatcacctgagccaagagagttcaaggctgcagtgagccgagatcacgccactgctctccatcctgggtaacagagcaagaccctgtctcaaaaaaaaaaaaaatagtaataataataataataaaataaaaaatgtgacctagagttgagaccctcgtattccaggaactccaggttggtgaaggtagagagaccagtgaaggctgggggaagccagctttggagactgctcctagcccaagaaccgatgttcagaagcagtgcctaacagtctctccctccagtgcctccctcccactgcagaaggaccatgtgtttatttatggatgtatttatttatttattttgagatggagtctccctctgttgcccaggctggagtgcagtgccaggatctcggctcactgcaacctccaccttccaggtttaagtgattctcctgcctcagcttcccaagtagctgggaatacaggcgcctgtcaccacactcagctaatttttgtatttttagtatagatggggttttgccatgttggccaggctgatcttgaactcctgacctcaggtgatccacccgcctcagcctcccaaagtgctgggattataggtgtgagccactgcgcccggcctatggatgtatttattgtaacaggtttttagtgcttactgtgtgctaggcatagttcttaggcttgacaaatagtagttcacgtaattccatcgctataaccttatgaggttgctactattctgatgatcctccttttacaggacactggtgaaggagcagtgaggaacctgcagagtcacacagttggtaagttgctaagaagggacccagcccagacagctggccctggatctgtgatctcatcaggaggccagagctgggtacagcagatgatgacaatggcttcagtattgaaaacttgaccacactaggctaacaatatgcagagggctgggagggggcctgcgctcaaagactcagcctccctaaggacaagtaaatggggtcctggctacttccaacctgagggggaaatgtcataccacaggaggtctatactctgagagcagaatctgggtctgctggagtagggtcccctgccagggctggcaggggaggtcctggctgctgcagtcatctcatcccaggactcagcactccctccctcctccacacccttgcttttgtggaggctctctgggaattcagactgagggtgctggactctggccaccccaggcccagacctttgggaacaatagcctggggcctgataacaatgccctttgtgtggggttaggaaggcaggctccagaccctgacttagaatagcagccacctgaccctgggcatctgattacacctctctaagctccatttttttttttcttctctgaaatagagacaataatagtatcttcctcatggggaggagtagggggtgggtttgtcgcatggattttaacaacgccttctacagcacttactctgtgcaggcacagttttgagctcttagcttgtgcttactcaatccacacaactcccccaggccaccaccatctctagatgggaagacagaaagtagttactttcccaagatctccccacaagcaagtgtatccttggggtttgtacacctactttcaccatggggctctgcctgcccccgcccctgcctcctctcgctgaccaattgagctgtgagcctggagcagatccgtgggctgcagacccccgccccagtgcctctccccctgcagccctgcccctcgaactgtgacatggagagagtgaccctggcccttctcctactggcaggtgagtcctcccagtctcctgggaccctcttgcattcaccccacccacaaaggcagcaaaagccagacaacatctcctttgggagtctggtgttcaatcagcatgctttatttaaactgccaatttagagagaaacatgaaggaaatgacagtacaggtaggatgagaatattgcaaaaaggtcctaatagctccagaggaattgaaccatggaaaacattaaccacctgtggcttgaagacaaaagcagggtggcacagcggctcaggcctgtaatcccagtgttttgggaggccaaggtgggaggatcacttgagcctgggaggatcacttgagcctgggaggtcgaggttgcagtgagctaggattgcaccattgcactccagcctgggtgacagagagaggttccgactcataaaaaagacaagcattccctgtttcttcagggggcagagacataacaaaccatcccagtcagcatgcacacaggagcatcaggaagcctgggacagcagggcttgggcggggccacaccctgaggctgtgtggggctggggagggcgtgaggaagggaactggtggctccagggtcaccccacaacctccgggctggggtcctgctgtctggcttacttggacaccagtgtcatgaattcccacacattttctctgctcctcccacacaggcctgactgccttggaagccaatgacccatttggtgagtgaggcccccaaacagcctgcccactctgcccacatctcccctctgacacccacatcctgtctcctggttctggttctgaagtctttttgccccactttttctagccaataaagacgatcccttctactatggtaagagctgatattcccacccccaccctacccttgcctatcctggacctctttgctagacaagttggtgaggggtagtgtggacctagtgtagacaaagtgggatgggggattaaacctggtctctgtgagagcgtcgctccaacaaggggagggtggccacaggatgcttaggaaccctcctggagaagggctggtgcctgggtggttaggcaccccgataaatcacccctaccctcttgccttcactcaccctcaccctccctttccctagtccccagccctcaggcagtcctcctctcctcctctcccctgggcctcagctccaggacagctttccttgatcatccttcaaagccctttctttgcgcatgtccacttctttttttttttttttttttttttgagacagattctgactctgtcgcctaggctggagtacagtggcatgatctcgggtcactgcaacctccatctcccgggttcaagcaattctcctgtctcagcctctcgagtagctgggactacaggcgcctgccgccacgcctagctaatttttgtatttttagtagagatggggtttcaccatattggtcatgctggtctcgaacttctgacctcaggtgatctgcccgcctcggcctcccaaagtgatgggattacagatgtgagccaccgcacccagcctcactttttttcttcttagtgtttccccacgagacgcagaatgatgcctctgttgctggcttgtctttatgtatatggcagcggctggcacaagcaggggctcaggagtgtcttttgaatgaatgactgaggccccaggctggtgcaagctcactctctgtacccaccccagactggaaaaacctgcagctgagcggactgatctgcggagggctcctggccattgctgggatcgcggcagttctgagtgagtggcaggacaggtggggctggaggacagggtggggctggcggacagggtggggcagaaagagagagtgctctcattccagcactgaccctggcgctgacccctctctctctcccaggtggcaaatgcaaatgcaagagcagccagaagcagcacaggtgagcctgaccctatggtgccctcctccttcggggcagaactacggggggacagtcctgacctggagagtggacagcatcctggccactcgctgggcttgcagctggctttgttattcagatagtcaaccctgaagggccccagtcaggaaagctctgacctcggtattgtgggaagtgaccatggaaggagagcaaggacttgcactcctggggccgggcagcaagagtctgggatataggggagaaggtcctccaggctaacctgatactactctgatgtggtcctttctctagtcctgtacctgagaaggccatcccactcatcactccaggtgagacgggcttctgtgggctgagggggtgtctgtgtaaggactgtgtctgatggcctgcccgccactctccgcaggctctgccactacttgctgagcacaggactggcctccagggatggcctgaagcctaacactggcccccagcacctcctcccctgggaggccttatcctcaaggaaggacttctctccaagggcaggctgttaggcccctttctgatcaggaggcttctttatgaattaaactcgccccaccaccccctcctcggtagtcttgtgatccatcgtctttgggtctgggggtgggtaatcccttggattgctgactttccctggatgcccactcccagcaagcttcccagtccctgagtccctgccgcccaactgtctcctatggctcccactccagcaagccccacagagagacccatgcactgtgagataccacagtgttataacagaagacctttccatttccaccacttgcacgggggccctagaagtcctgatgcctcaggtacccatgacttcctttaatctagagcgacccccagggctcacccccccattgagacctcaattgagaccccccattgagacctcacccagtgaatgctctctatggtagaaaatgtagcaattcctttgacccatcccagtaaaatcctcagctcaccccatgggcccccctcctcccaggaaatatcctgtgaaattccatgaagaagtatgtctcgagaagccctgcatagtgcatgtgggagacaaacaccatgtgtgcaaatccaagttctttggcatgcctgaactcccctccaggaagacttccctggcaatgtccctgtggcaccccaggcaggggtgtgaagtgccacttctgcctggtgcccatcctgcagtcctgccccttgacagcccaggagaaggaactgagaccacttctagcctctgcctccagcaaaggccagagaacaatggagtccccgccaggtggcagctcccaatctgaggccagggcttgggctgggcagctgtctccaatgatgcacccttcctccatgtctcagggtgggccacatccttgagaagtatgatgtatcctagacttagggtcacctgccttgtgggtggggtcagagacttgtgcagggccccagaggtgtaaaaatgaggtccacatgtcttccagggcctttgaaacaggacacgtagggactgagagcaaggttccaaggtggggctgagtgggactaaagatacctggctgagtccagccactatcagggaatcttgggtgggtcacagaaggcctggcaagccccagtgctttggggaagctgtcctgtaccagcagccccaggtggtatggccagcccagaggcagcgctgagtctgcacaggtggacctagggaggggcctgtgcgcaaaccaccctggtggagggaattagcagcacgactggaatgcaggcgataggatcactgaggaggcaaggcccagccctgcaggacgcagaggcaggggtgggagccacccagcagggctggtagaagggggctcctgagcacgcctcctcatccagggggtgcagtgcagagctctctcctcgttggcacgggaagacgctggtgtgagagactgcttttgagaacatgaaaagtgcggtaagaaagccaagtctggagtggcagacccaggggaagccacacaaaggtgaccggaagcagtgcatgctttctgactgaggaacccagggccacgcagtcacgactatcaggagctctgctgtttgaaatcctagcaaaccctgtccttgcatggtggccccatgaccctgacaagagatgcagcctcaacttccaaccccagtgccccactggggagcagaggtttctggacgtgacagccacccacctccaccttcacatgtatcctggggccacgtcgtggtggagacctgccgctcttctttcaagctctcatgctgcttcatttaaacttctcctggacaggtgtcacagttcccccaagtcctataagtgaccacttatgtaggaggccccaccacacgagtccctaggtgtgactgtccagtgacaggcttatctctctgatgtggagggtgacggctctcgctcatggaacctgggaaaatcatggtgggaggagtcagaaactgatgggaggccaggtctggatgacagtggaggatggagtcagtgttagccccagatggacaaggccaggccctggagttgggaccctggttcccaggggaaacgagctctcctctctcccttctgggagtgaggaatgggctgactagggcatgacagaggctctccaggcttccctttgtgggattactggctgtgcgtcagagaccccttcctggggcctgtttcagagctggtgggtgatttccccttgtcatcctctcctagttgaggggctgtggggagaggtaggggggaccagagaaagcaaagtgtcatttccactcaattggggatttactgagtgacagacaccactgtaaacacttcacacatgtcaaattttcctagcaacctatgtgatgcggatgacattagggttagggttaggttagaggagaggaggcacccagaggttctcatgggctaacgaattccacagccagcctccaaccctggtgtcctgctcctgagccctgtttccaaaggactggggcctgttgccttcccgatgtttatcattgtcaaagacagagcccagggactgtgctgctgggtgactatacatccttcctcacttttttattttaaaaatcttttatttttcagggctgggttcagtggctcacgcctgtaatcccagcactttgggaggccgaggtgggaggatcattttgaggtccagagttcaggagcagcctggccaacatggtgaaaccctgtcactactaaaaatacaaaaattggccgggtgcagtggctcatgcctgtaatcctagctactcaggaggctaaggtgggaggatcacttgaacccaggatgtggaggttgcagtgagccgagatcgcaccactgcactccagcctgggtgacagaccgagactctgtctccaaaaaaaaaaaaaaagaaagaaagaaaacaaacatcacagagacatttactcacaaagtaaaccaacttctaacctagcaccccaaaataatcaagtttaaaagtttgcaaaaaaaaaaaaattgttctctagtctttcagatcatcttttccctcttgtacctgggagttggccttgtgagtttggaatcagaactcaggctattgccaggcacagtggctcaagcctgtaatccaagcactttgggaggctgaggcgggcagatcacctgaggtcgggaccagcctgaccaacatggtgaaaccccgtgtctagtaaaaatagaaaattagctgggcgtggtggcacatgtctgtaatcccagctactcaggaggctgaggcaggagaattgcttgaatccgggaggcggaggttgcaatgagctgagatcgtgccattgcactccagcctggcaacagagtgagactcggtctcaaaaaaaaaaaaaaaaaggtattgtttcagaacccaaaggtgaggactagagaaaggacttattattctgatttaaaataatacttttttttttttttttttttgagacaaagtctggctctgtcgcccaggctggggtgcagtgatgcaatctcatctcactgcaacctctgcttcagcctcccaagtagctggaactacaggcacatgccaccacacccggctatattttttgtagagatgaagtctcgtcatgttgcccaggctagtctcaaactcctgagcttaagcctcccaaagtgctaggaatacaggcgtgagccatggcacccagctctctttttttaatttctgtattttttttattttcttcttttttttcttaaaactgggtctcactctctcacccaggctggagtgcagtagcatgattacagctcatggcagcctcaacctcccaggctaaagcaatcttcccacttcagcctccagattaggtaggaccacaggcgcgtgtcactatgcccagcaaattttttcttttgagatggagtttcgctcttgttgcccaggctggagtgcaatggcatgatctcggctcaccacaacctctgccccctgggttcaagtgattctcctacctcagcctcctgattagctgggattacaggcatgtgccaccatgcctggctaattttgttttttttttttagtagagacggggtttttccatgttggtcaggctggtctcgaactcccagcctcaggtgatccacccacctcagcctcccaaagtgctgggattacaggcaagagccactgcacctggcccagctaattttttttatgtagagatgggctctcactgtgttgcctaggctggtctggaactcctgcgttcaagcaatcctcccacctcagcctcccaaaatgctgggactacaggcgtgagccacagcacctggcctgcatcttttttctcaactaaaacaaaacaaactaaaacaaaactaaaacaactaaaacaaaacaaactaaaacaaaacaaactaaaacaactaaaacaaaacaaactaaaacaaaacaaaacaaaaaaaccttacatttaagataattgtagattcacatgcaattgtaaaaaataatggggagagataagccagtttcccccagtggcaacttcttgcatagctatagtacactatatcacagcagaatattgaaactgctagaagcattggccttactgagatttcaccagtgttacatcactcatttgtgtgtgtatgtacgtttagttctgtgcaactttatcacctgtgatgcctgtgaccaccacagtcaagatctggaccagttcattaccaggatccctcatgctcctcttttatagccaaacccatttccctccctacttaggccccctaggcctaacctctggcaaccactaaactgtcctctatctctatagttttgttatttcgagaatgttaggaccgggcacggtggctcacacctgtaatcccaaaactttgggaagccgaggcaggtggatcatctaaggttaggggttcgagaccagcctgaccaacatggtgaaaccctgtctctactaaaaatacaaaattagccaggtgtgatggcaggcgcctataatcccagctactcgggaggctgaagcagatgaatcacttaaacccaagaggaagaggtgcactgcattccaacctgggcaatagagtgagactccgtctcaaaaaaaagaaaaaaaaagtgttaggctgggtgtggtggtgcatgcctgtagtcccagctacttaggatgaggcagttggatcacttgagagtttgaggctgcagtgagccgtgatcgcgatcatgccactgcactcgagcctgggtgacagagcaaggcccagtctcaaaaaaaaaaaaaaaaaaaaaaagagagagctatcatctcaccactgctctttagctctttagcatgggcaacagagtaagattccttttttttttttttttttttttagagacggagtctcgctctgtcaccaggctggagtgcagtggcatgatctcggctcactgcaccctccgcctcctgggttcaagaattctcctgcctcagcctcctgagtagctaggactacaggcgtgtgcccccacgcccagctaatttttgtaattttagtagagatgggatttcaccatgttggccaggatggtctggaactcctgacctcaggtgatccgcccgcctcgtcctcccaaagtgctgagattataggtgtgaaccaccgcgcccagcccaattcttttaaaaaaacaaaaactgataataaaactgagatgccttgagacttgatgcatctgtcagcacccaaatcatgagggtggtcttagtgcaggtgacttatctcccatactgctaagtacttgggggcagcttcttgaaaggtaactaggctgggcatggtggctcatgcctgtaatctcagcactttgggaggctgaggtgggcagatagcctgaggtcaggagtttgagaccagcctggccaacatggtgaaaccctgtctctactaaaaatatgaaaattagccaggtgtggtggtgggtgcctgtaatcccagctacttgggaggcggagacagaagaatcgcttgaacctgggagacggagattacggtgagctgagatcgcgccactgcactccagcctgggcaacagaacgagactccgtctcaaaaaaaaaaaaagaaagaaaaagaaaagaaaggtaactagccctctcctgcagaaaacgtggccttgattcagaacactcagagtttcagggtttggcctgagtgtttactgagacttatcagaggtgccacatgaaatcatttaggaacacaggtacctctttgatggggcctatgctgtcatttgtagcagatggcagaggagctggtggagtccttgcatccttctggtcacctgataattagcaggagtagtatttcctttttttttttgagacagggtctcactgtcatccaggctgaggtgcagtggtgcaatcttggctcactgcaacctccgccacctgggctcaagcgatcctcccacctcagcctcccaagtagctggcctacaggtgtgagccaccatgcccgagtaatttttgtattttttgtagagtcgagtgtcttgccatgttgcccaagctgctcaaactcctcagcttggccgggcacactggctcacacctgtaatcccagcactttgggaggccgaggtgggtggatcacctgaggtccagagttcaagaccaccctggccaacatggtaaaaccccatctctactaaaaatacaaaaattatctgggcgtggtgacacccacctgtaatcccagctactcaggaagctgaggcagaatcgcttgaactggggaggtggaggttgcaatgagccgagatcgcaccaccgcactctagcctgggtgagtgagactccgtctttaaaaaaaaacaaaaaaaaacaactcctcagctcaagcagtccacctgcctcagcctcccaaagtgctggcattacaggtgtgagccactgcgccaggcctcagggtattttcaagggtcaaagcagctttctccaaaatccaaaaactactacccaaaattatgcctctttcaacacccggcatttttagtgactcaagggatgaaaattcttatcaggcccttacttgcttacacattaaccactcgctttttgcccagtattccttgttcccataatgaaattatgaactgctgaaatactgttccttgtgaaggaggggataacttcagggccataaaaaaattttgcagaagtaatgaatgtctttaaacacactgcgaccagctgcagacacccagaagtctggttattcaagacactatgtgagactaaagaaacacagacttttcccccctcggttctctgaaactgcccctcccttagtctctagctgtgtaaaaactccccatgcctggcatggtggcttatgcctataatcccagcactttggaaggccgaggctgtagtgtactatgtcgattgggtatctgcagcaagttcggcctcgctatgacctcccaggagtggaggaccaccacgttgcctaaggaggggtgaactggcccaggttgaaaacggaggtcaaaacttccatgctgaggctgtgcgcggtggctcacgcttataaccccagcactttgagactctctcaaagtcactgcactccagcctgggtgatatagggagacccccatctctaaaaaaacaaaacaaacaaaaaaactccacgctgcttctttttgttaaggcagatttctcaccttggccaaatcaaataaacctttatctccaagcacctttgtcttggtgtttggcatcagctacacatcaggtacgcaagcctgaatttggggttctacaacataacaagatgcagtatcttgacttttaccttgcagggaatgccctagtcatgcccaaggccacaggttgaaaaacatttcctgtagtgtcagtaaatattttaggttttgtgggccatgtggtctctgatacaactacccatctctctgcctgctgtagtacctgggcagccatggacagtattaacaaatgggcacggctgtgtgtagcaacaaatgggcatggctgggtgccatggtgcatgcctgaaatcttagaactttgggaggctgaagaatacagatcacttgagctgaggagttcaagaccagtctgggcaacatagtgagaccccatctctacaaaaaatacagaaatcagccgggcatagcggtgtgcgcctccagtcccagctacttgagaggctgaggtgggaggataacttgagcacgggaggctgacactgcagtgagccaatatcatgccactagactccagcctgggcatcagagagagacttgtccctccccaacaaaagttaacaatcctggagcaaggggatgttttgctgtccatgttatgttgttaccttgggatgtcaggtcatctaacacattccctttcccatcccctggagccctttccacccatgcatcctaaatctagcatagacttccagggttgtgaaggtactctttgaatctccaccactctacgaaatctgaggtctcatcttcatggcattccagccccatttccagcggaaactccacctgtttctgtgggtctccctcacctacaggcctctccttccccatgcagtgctgacacttgaagcatggtaggcccatgggtgggcagagatcccagatcagggttacagcaaggacagttctccctaggtttcccccatgccagtcttccgagtgcctctttctgcgtccctgtaccctgccattcctggtgatgctgctgccctcacatcaggccatccaagcatgcagaacataagcatgcagaacactggaacgaagggctgtacctaaggtgagcctctgaagcccaatgaggctagaaaaggctgaagacttcacagacctaatttttaatgcagctctcaggggttttaccaagagcatttatttactctttaagatactaatgaagacccttaatattggtaaaatcataacatataggttacattatacagctagtgaagtgggaaaataaagttgaagaattcccaatggtagatagcatttttgcacagaatggttttaaataaactccacattttaaagtcctgatggtttgtatttagcataaggtttaaaatgatagtaatactgtatgctatatatagagctgcctgaatttcaacattgctgttgccaaggtagatagcaatttgaaaatgggtctcaagcttgataatgtgtatcctgtcataacctaattaacaaatgcgccctacagaaatcaggagcgtgaccaaaaaaaaaagtttaaatcagcattttataaaaactagaaacaaaataattgctttcacaatgtagtacttgaaactaaagttctccagctatcaacagatgtgactccagcatcaagggcctagcaggaaaattctgaatggtttacaacagtgcacataagttgcaggtggctggggccgtgtgtctatttgatgcttcccagaatgtgtgctgctagtcaccatttccaccattcacatatttaacatttttattagacttttatttagcctcatcataagaatataagggagatcatagatttgatgtatgaaatttttaaattcacactaaaatacattacgattaaaatgaattatcttcaaccacccgttttgctatcttttgctgagtaatctgtgccagtcattgtgaaaaagtctttattttaagaaaaaaatttagttaacaaaaaatttaacaagtttcacttagcaaaatacacccaaaaggaaatcacagtacaaagaaagttttaagtcaaggcctcaccaattcctacagtattagtattgtgtctcaattctcaaaactaacttttaaaaagcttaaacttaacctaaaggattttaaatgaaaatataaactagaatgaacaaacatgagaaatatttctttgaatcagggagctagcacctttgagttttccaaaaaagcacgtctccccagtgtgttcactgtgatgtggtgtaaaagatccacatttaacatacttaaactacttaaacttagataacatcactctgaagtatactaccaaaatgttaattgagaaaagctgaaaatagttttagtttactcattatcacatgctagaagaaaattttgcatgagaaaacactgaagaggtaattttttaatccagatttttcacaaactcatggtgcaaaatgggtcccccagcttcctctattataactgctcttaattgcttgttggctgcctgtgaaaatgattgaagtaactcaaatgttcctaacaaaactagtcatagccacccatgctgttctgcccactgtagccggccccgtaacagccactcactgactggctctccaggccactgtaagtggcctgggcagcagacacccccatgccttgcatcacctggctgctatacgccccattgctggcccctgttgttgaattcaagaagagttctatatatctgtgctgcatattggccctgtctttggacatagctgccacagcttcttcatgagtagcaaactcaacatctgcttcacccgtcactcttccatctgggccaatctcaatatggactctcacagggttgagaggagagaagaagttgtaaatgtcgttctcggtcgctttgtacggcaggcccctcatgtggacacagtggcctgtggtgctctgcactgtgaactcactgtcgccgtatctgtggtcatacattccggagagacagtagctgaggtctctcccgaacaggtcggtggtgaagccgtagccatcactgaggccactgtactcctcgtagcccccgtagcctgtgctgtaggcaccaggcctcatcctttccaggcctgcctgcttcacgatgccaatgtacctcctggcagtcccgggccggtcatagggccctggccgctgcacggacatgaacttcagagggggatctgagtatgacctaacttcctcctggctgctcttaaacacctcaatgtacctgtgccctatcctctccttgtgtttccctagagccttctcagctaactcctgcgaggcaaactgcacgaacgcttcccctgtaatcttgccttcggggtccacaggcaatgtgatcccgtttggcacaatttccaaccctgagaagaactgaacaatttcttcctttgtgcatccaaatgggagtcctcgaagccgcacgaagccatcgttggcgctgtcggcactgttgggaccactgtgcttcaacacccaatccatctcggttctgtgggacttgaacacctcaatgtaccggtgtcccatgctttccctgtcttttttcagggccatttttacatcatcttctgatccaagttcaacaaaagcctcaccactctgcctgccctctctagtgtagatgaaatggacacctgcggccccatcatgaatcgtgcagtcagagaggaagttctgcacgtcctcaacagagcaggaccagggcaggccacggagcttgaccacaaagccttcacctccctcagggcccagcatcatggacacttgtcagggtgggtgtcaggtgatcttgggtgtggcttttttgtggctggaaaaaaaaaaaagaaaaatttatttagtatgcaacagaaattttccccattttacagacgagagaggtagcaagacattaagaaatataccaaatacaattgagagctaagagttaactccaggtctctcaaaaaattacattatcagtcacaggcagtttgaaaaacaaatcaggagtttacaagacaggacgatgcatgtgaatgtggtgccttgaacacagagaaatgtaagtttcagtcagtttagagcaagggcatttccttgttatatttattccacatatttgtcatgataatatgtggcagttcacctataagagctcctgagttgttcctcctaaactatacgccttacatttggtaaaatagtaaatttagtaaatctgcttgtctatggtaggatacttttactttcatgagtaaaaataagggatgggaacatagcaggctgtttttaaaccacaacatagggtaagattttctagtgttctcatcagcagtaatgttgccaggatacaagacagcaatggcttccactgtctatggagttatgattttgctcctaaattgtcaattcaaactaaataccagtcaagtatgaggccaaactgatgacatatacagacaagcagacaaattcaccagcagacttagttatgtgcactgcaaataaatggagaaaccagatcagatgattcacaggttcacataaaatatagcagaattgctgccttgtgctgaagatctggaagagggcatcgggaagaaagggcaatcgcaagagggctgagaaatgcccttcccaccagggtggtacatggcacctgaagtccaaactcagagtaaggccaaccacacactggaaggcagtcttctgagaaagaggagcagctgacctagacagcagggtctataacatagtcacaagcaagaaaaacactgcagtatcatggggccaaagacgtatttttatatgaacactgtcaagggtgacgctcaaaaagagcataggagtatatggaatttttttttttttttttttttttgagacaagagtctcactgtcgcccaggctggagtgcagtggtgctgtctcggctcactgcaacctccgcctcctgggttcacgaaattctcctgtctcagcctcctgagtagctgggattacatgcaccagccgccacgcacggctaattttttatacttttaggagatacgggatttcaccatgttggcgaggttggtcttgaactcctgacctcaggtgatccgcccacctcagctgcccaaagtgctggaattactggcgtgagccaccatgcacagctggaaatcgaatgtttcaaagtgtcattttacatcaagcataatagatatagctggtggccttttcaagaaatatgggctcatcatgtggggaaaaaagctccataagaaaaccccacaatttaaaaaacagacaaaaagtaaaggtaagtgtaatttaagaaaaggaaaagcaaattcatactaaataaatgctcaactgcactagcttcagggaaaattagtaattttaaagtttgatgtagccattgcagataatgacatattatcatacagtgcttcatcatttcaaattgacaacgtctaaaaggataattgtgtaaatctttcaaatttacctgtgtctacaccagattataaagataacaagatgtgtctcctctcccaataacaagcataatggcacaaatgaaacagaacagtatgtgatatcctgaacacatcaccaagaccaaacactcggcatttactcacgaactgtgatttggaatgcaagggctttcaaagtatacagcctaactaaaagatgtcacccttgctaatgagagtggaacatggaagcctctgggaagagagtcaaggggagcctaacctggattgctcattgcccacctcaaattattgactatgtacataaactccatcaacttttataaaataatcctgaacggcaaatgattgggcataaataatcctatccccaattctcaaactgtgctttgggtctgcaacaaaccctggggtttagcctccaccttagaaagtaatggtctccgcctccccagggccttatctaaatcccctgcatatggccactgcaacatgctgatctggcagagcaaggtcacagcagattcttcctctcctgtccacggagggaattctgtgctaacagttcagaagctcctccttggagagtcagggcaagtttgtattgtgtctcttgggataatgggtctgggacagctcaattacaggtgggggcttcttatgcaattccattcccaacactgggtcaggctaggcaccgcctgtccttttgtctttgaccataccctggtcttgctcctcactcatgaaaagtatctgaaggcctccctcgagttctgttcctagccttaggtccagccatcgttccgggtaggggagatgaagccataatccactaaccattttctcctggactcctacctccaatgatttcaccattccctgcaggaaaccccacctaatcacatcctactccctccaccacaactgctatccccctcctttgtagagaccttggcttccttatccacacagcctctttctctcctcattcttcataatccagcttagagcaagtatcattttacattccttcctcacaatacatggaattcattcaatgaacttcttaactgtacgcgcccagtaaaaccagagctctggaagattccaaacaaatatctgactactccatggatgtactgagtggctcagctgcacacagccaggcgaaacggtgcctctaagctacaatttctcagcctcaggactactgacattttggaccagacagttctttgtgttgtggaggcaggcccaggcactgtaggatgtttagctgcatccctggtctctgcccactagatgccagtagcaccctccacctccagttctgacaaccgaatgtctccagacattcccaaatgttctctggtggctaatgctgcccccaagttgtgaaatactgtagaaatcagggtgaggccaggcacagtggctcccacctataatcctagcactttgggaggccgaggtgggtgggaccacttgagatcatgagttccaatagacaaaacctctgtctcgactaaaaatacaaaaaactagccgggcgtgatggtgggcacctgtagtcccagctacttgggaggctgaggcaggagcatcgcttgaacctgggaggcagaggttgcagtaagccaagatcgcaccactgcactccagcctgggcgacagtgcaagactctgtctcaaaaaaaaaaaaaaaattacctggacgtggtggtgggcgcctgtagtcccagccactacggaggctgaggcaagagaatcacctgaacccaggaagcggagttttcagtgagtggagatcgcaccattgtactccagcccgggtgacggagcgagactaactccaaaaaaaaacccaccacacaagaaaaaaaaaagaaaatcagagtgaacagccatagagtaagcgggccctcaatatcgcccactgtcctaccccagcaccctgcttgtccaaagcccttcagatgtctggggcagccttacagactctcacctcctctccagctggttgacattactcttggaagtggactttgtgaagtcaagtcagagtccaggagtttgtaagcacgtagtgggccccttacagcggacatcgtgaacaacagctctgctctgggtccaacctcacataccccggagccatgctttcttctttttttccttttcccctttctccactgagccctgtctacttggtaattaaacatgctcagttctacccaatcatgtcatacctcccctgtgccaactttgcctctagctacttgttgatttgttcagcaaaatcttgtcaaaaggcctctactgtcacttccactcccctccattaaaactgcatgatcaaggccacgtgtggtggctcaccgcctgtaatcccagcactttaggaggtcaaggagggtggataaccggagccaggagttcaagaccagcctgaccaacatggtgaaatcccgcctctaccaaaaatacaaaaattagccgagcatagtggtggacacctaggttgagcgcagtggctcacgcctgtaatcccagcactttgggtggccaaggcaggcagatcatttgaggtcaggagttccagaccagcctagccaacatagtgaaaccctgtctctactaaaaatacagaaaaattggccgggcacagtgcctcacacctgtaatcccagcactttgggaggctgaggcaggtggatcatgaggtcaggagatcgagaccatcctggctaacatggtgaaaccccgtctctactaaaaatacaaaaattagccaggcgtcgtggcgggcgccagtaatcccagctactccagacgctgggacaggagaatcgcttggacctggaaggcagaggttgcagtgagctgagatcgtgccactgcactccagcctaggcgacagagactcgtctcaaaaacaaaaacaaacaaaaaaactgcatgatcctactatacagatctccatggcaagaaaaagagcaaatgtttttatcttcatcttacttaaccattctttcctggaaatcctctccctttcactcctgttggcaattactgttggttttccagttaattccttagacagtctctgagtccttccttaaccattaactgtagggaatcaggcttgggcccaagtcctcttctcagtggactcacctgctcccagggtctccataatcatctccagggtcaggagatacacaaacccccagtcttcggctccctgaagcctagacgggtagacacaactccactccacaggttctcctctgtgccacaactaaacctcacattctctcttctgtcacactccaatagcaacatgactgcccctacctgcacccagaggctctagaaggaaactggagtaatccttgaccttctcccaagccctcaaatccaatcaactcaactcccttgggtgatcccattctccacagtatcctcatccctaaatcctattcaactcttccatttcctcagcaataaaggtgcctcacagctctaccctgttcctaacacgttgaatggcagcctatgaactcagtaattcttttctttgtaatgggagttatcaaattgtcattttctttctgtacctcatattgttatttctcctattctaattcctgtatgtacaaacagccaattccagattaccgatatatcttttaaataagtccaagcataggccgggcgcagtggctcatgcctgtaatcctagcactttgggaggctgaggcgggcaggtcacctgaagtcaggagttcaagaccagcctgaccaacatggagaaactccgtttctactaaaaatacaaaattagccaggcgtggtggcgcatgcctataatcccagctactcaggaaggctgaggcaggagaatcgcttgaacctgggaggcagaggttgcggtgagccaatgtcgcgtcactgcactccagcctaggcaacaggagcaaaactccatctcaaaaaaaaaaaaaagttttccaagcacagtggctaggccttactgcaatcccatctacggctcacgtgtacttttaaaactcattactgtcctgcatccaagtcctcagtggtttcccactgacctcagaacaaggaccacaggcccaatggggtccctcaggccttgcaacttttgcctgcaacactcttctacctaagctcacatcacttccttttttctcctggaatgtggcaagctctctgccccttcagggatgtgacgcacatagttgacactcatggttaattctctccccaaatatactctgttcaaccttctgtctacctaaatcccactaatccttaaggtctaagctcaaatacaccacctttctcaaaggtcttctcattatccaaattaagtctcatgctctacactaaccacagcactcttgtgttgttaaaggggtcttaaacccacaataggagcctactggggagaaacttgtgcctgttttgttggccaccatgaccccatcctcagcacagacttgacccagctggtccaagattagccaggattaactgttgcccatgtgtaggggggtcaacaccttcctcaagaaggcagtggcctggctaggctgaaaaagacatacaagcagcataaaaaataaaaacatttcatagaagaattacttaaaatgcctaatcttttacatgtcataagtgttttgcatcaggaaatgtttcagaagcaaaattacttcctctctgaaggcaaggcgaagagaccattcctttccaaaacacatgtgtacacttaaaacacttactgcttatttttactccagaattggttttctgttccatttctcagaagtcctaaggcttttcattaactaaaactcaagctgaaaagagccctgtggtgtcctgctcaaggttaatgttagggacaaaacttttttcactccaggctgctaaacaaatttgagtataacaaatataaatactgcagctgaaaaggggctcttcttaaaatagcttaccttaaaaacaaccacggatgccttcagtgggagacacttctggatggtaatgaaatgtcctaaaaaaaaaacagagcgatattggctgtgtggtctcagatcctaggcactggctctgggatcagaactccaggtaaggacagaaacagctgggaagccctttatatagcccgtgggtttaaattaaatctcacaccccatccacctaacagcattttggaagtattatcttttcacagggcaatacagagcacaacaaaagggaaacgccttattgatcttgatgagatttactcttgatgagattctcctgcctcagtacctggtattacaggcgtgcaccaccccacccagcgaatttttgtatttttagtagaaatgggatttcaatatgttggccaggctggtcccaaactcctgacctcaggtgatccgcccgcctctgcccaattctaagtttgtacactgaggaccctaagtgctgggaggaaatttaaatatcgggggcagggcacttgggagggagatgggtgggggagaagtgacaaccacaggggacttgaccttaagacccctctttcactgggatagcatgggcaaggagcaagggtgcttgctagaaattgttcagtctgatttataggaacccctctgtaagcagtgtggagacacatccaaaagacactttcagttttattgggtaacttctttgaaatatgcttcactagaacatacatcataatcactagatcaccaacatcccagtaaaaacgctgccccaaaggactaggacacgggctgagggctatggaattctgagaactaagctgcttgagttttggaaatgtggaattagtaaaaccagctaattatgctgaacctgttgtcttaacatgaagataatcaaatctgccttgtcttgcaaacttccagtgattattacttaagacactattgggggggtgtacaaatggaaagcattacatttattaggaaacctattcaggggtgaaacagtttcaagtactctggaatcaggttttcaaaaggcttcaacaatccgacttgttcaaggatctaaagggtggaacccagtcatcttaatgatctgatccacttatgcccttgtttatccctgcgtgatccacagaccaacaccctgaggcgtctctggggacatgcacaagctggcaaccagacccacgtacacccatttaccccaatggaccagccgctgtaagcctgtagaccacggccactgcgcaccgccaacgcacgcagaggaagagtctggtctccccgtccgcagcgccaagaaagcgctgggggcggggagggctgctcagctcccccaggtgactggacccggaggttttcagatcgagcttgcacgggggccacctagataattaaaacaccaaccctaaaacagatctgggtgggggctaagaatctgcatttccaaaaagcgctcccgaacgagctcttcgcagtgatacaggttggacgggattaacgcttgccttcaggcagagccaatcaagataaatagggcgcgccggagtcctaccagttcggctatctgcagagtaaacagggccgttcaagcaccacccacctcgttttcttttgttcaggacaggactcgaggaaggatcctggcctcccctcctagacacactcccgtgcccccgggaaaccgggcagcactctcgccaggaggctgggagcgcgtctggccgcgccgcccccattactcacttagttccactctcaaaccaaagtccacccggccgggcccgcggactttcatgctctagacttaccacggaggcgagcaggactggtttctgttgctaccaggcaagcgcggctggcagccaagagccccgaaattccaccgaagctcaaccacgcagagggctccggggaaactccaggtgcatgtttttgttctcaacctgcaacagaaatccaagtggtggtggggtcccttccgcaaggtgggaggcccgggcgcgcggtaaacgtgttttggcgggaagcagcgccgaggccccgagacaaggtgacggcgacgttcccgcggcctgctcacggcactccagcagcctcggaccgcccggcccggcaggaaggtcggccccagggcctgcgcgggctcgggcgggagcttccgggcggggggcggagcgagcggcgcagcggggagagtgggggcagggacgggagggttcccggagggaagggcgcctcgcgggagggggaggggaggggaggggaggggagggggcccctggcgggcttccggggccctgagggcgagagcgagggcgacggcaaggtggggtgggggctgctccccggcccgccaagctagcgctgcctaggcgggagctcggggacccgcgggccgagcgcggctgaagggagggaagggaagaggcgctcgtaggtctgcgtccgtctccgagcgaccggggcggcggaaagggacctggggggggcggccgggactggagtggcggggccggggcgcccgcgcggcggctcaccacgccagggactggcccgtcggccccgaggaggcgcggggtccggagtccgggaagcggaggcctcgtgatccaagaccggcagccggacgtgggtcacggggtgcagaggaggaagtgccattgccgggcccgccaagatgtcaccaatgggaaacgcgtgcctgcaggtgcggccccgtggcccgcgcgctgggcccaggcaggaagtgggggaaggagagagtcagggcggcgggaagacatttctccgagttctcccgaagggagccaggcgcgagcgcgacctggggaaagtccagagtgccagccacggggaagggcgggcagtgcagagtggaagagaagccagcaagttagacacagcccctctctgggaggccgcctctaaaatggaactagcggacgtaccttggtttgtacatttgaccatggacacacgtaaagattttgaaaaaaaatctttgaaaaaaaatttttttaacgcaattcctaaacttttaactaacgcaattttgtggacctctgaatcttaattcaaatgaactggagaacaactataaagcaatttcgataatatgatcagtgacattttatattgcagaattgtaaattttgttgtcattatactgtaattttatttctttaaaagaccctttttagagccacaaatatttgcagatgatacctgatttcttgaatgtttcagattacgtggaaagtggaaatatacatgaaacaagatgtgctatgaactagtaatttttattaaagctcctgatgtatacatagagtttcattacacttgtttctacttttgtgtatgtttgactgttttgtttgtttggttggttttttttgagacacagttttcactctgtcacccaggctggagtgcagtggcatgatcttggctcactgcaacctctgcctcctgggttaaggcgattctcctgcctcagcctcccgagtagctgggactataggcccatgccactatacccagctagtttttgtttttagtagagatgtggtttcaccgtgttggctaggctggtctcgatatcttgacctcgtgatccccctgcctcggcctcccaaagtactgggattataggtgcgagccccatgcccggcctgtttggagtttgttgttgttgtttttttttttttttgagagacagtcttgctctgttgcccgggctggagtgcaatggcacgatctcggctcactgcaacctcccctcccaggttcaagcgattctcctggcctcaacctcctgagtagctgggattataggcgtgcgctaccacaccctggctaatttttgtatttttagtagagacagggtttcaccatgttggtcaggctggtctcaactcctgaccttgtgatccacccacttcagcctctcaaagtgctgggattacaggtgtgagccaccgcgcccggcctgttttacgtttttaacagaattattattattttgagacagggtctggctcagctgcccaggctggaatgcagtggcacgatcatggcaatgcagcctcaacctcccaggctcaagcaagcctccaacctcagcctcctgagtagctgggaccactggcatgcaaccacacccggctaatacaactgtttgtaaaactgagagaaagcaagtctttagaatgcacttactaaataacacgaattacagggaacagtaacatactgcatatagtgatgtagactgtgggaaactacaaggacaaatgagccagtcctacctcagaatagttccagccagataaaagaacccacagaattatggttatgttataaaataaagcaattaagttttagaaatccatcttgaaatatttgtgatggcttggatttgtttgaagttgtccacaaagtagtaggtggggagatggagaataactgtccatgattagtaactgttgaatctgtgtgacaggcacattagcctcaacctcctgggctcaaatgatcctcccacctttagcctccccaacgtagctgggaccacaggtgcatgccaccaagccgggctaattttttttttaattttttagtagaggcaaggtctctctatgatgcccagactggtctgtaactcctgggctcaactgatccaccttggcctcccaaagtgctaggattataggtataagccactgtgcctggcccaaggcaagttttaattattgatcagtcaccatagggttcctgcctgtgagggaacaatgtgtgcagaagacttgagccaggggttgtattgtgcaactgcagctaggtctgagatcaatggtaggagatgacatagccttaaaggcctggtttggtgttcaaaggccagtgggaaggcatttaatggaatgtggtgtgaaaggagttttgctttttaacacaacagtctagatgctatctggaaaatgaatggtgggaagagatacatggagacaagatgggaaggaatgaaacaagtctaggaagactggtgggagaagaatgtgaaagaatgtgtaatgtagagaaaaatgactgagtctggagactgactgactcaccaagaaatactacgcacctaaaagatacaggaactgtagtggtaaagagacacagttcctgccttggtgggtccagtaacagtggagtaggaaatcaagaaatgtacaaatatatgatgacaaattttagaatgaacgaaaaacagaaaataggcattagctcagattggggttctgaggaagtgacatttaaacagacaggagcatgggtgagtgggaacactgagtgatgaatttcatgtagaaagaagggaaattcttttttccttgataaatagctgaggtttaaagtagaagctggccaggagcagtggctcaagcctgtaactccagcactttgggaggccgaggtgggaggatcacttgagcccaagagagttcgagaccagcctgcgcagtatagtgagactcccatctctatataggaaaaagataaaaactgagggaaaaaaaagaagttaaaagcccattattcttttttccttctgtacattatctcccctctggacacttgttcaaattatttatattttttaccaaagccctttactgggatacattttggtgctggatgctttgtattcatattcttatttcgtggtgaatcctttagattgaagaaattttaggacacagcttctgctgctcgtgtctgttcaccacatgagaagcacaagatgcatcttgggggcaaaaattccccatcatggtatatagtatgtgagcagatcatagaccatatttgttatggatgttttccttttctgttggaaatattgaaaattgggtttaatggcctcaaaagtatcttccaacccagcaattttataaaattcctattcagtcactcttaagtacttcctgctgtcatgaactcaagaattatgatacaagacactaattccatttaaaaaaatgcaccaacgcacacatttgtacttaacttttcaggggcacatgtatctgaagtgtgagaattctaacccaattcacacaacgtgccaaattcaatacacagagctatcctaaaagctattaaggactgagaagtggccaggcacagtggctcatgcctgtaatcccagcactttgggaggccgaggcgggtggatcacgaggtcaggagggctaatacggtgaaacctcgtctctactaaaaatacaaaaattagccaaacgtggtggcaggcacctgtagtcccagctactcaggaggctgaggcaggagaatggtgtgaacccgggaggcggaacttgcagggagcccagatcgcaccactgcactccagcctgggcgatagagcgagactccgtctcaaaaaaaaaaaagactgagaagctgcagatggagcatatattaacattttaaatgtttactccattattactacatttatatccaccaaaggggatctgtcctgatctgcatgcaacaggaaagctgttttccattaccatctatcaggtcctttcacttacttgctgtagctaagtctggggggataacacactgcttccctcagcgttcatttctcaaaagctgtgttactaaaaagcatcaagagtagtataatgtaatgttagataaattttatctatactgtttgtactgaaattaatataagggacaaattctgaccgatcataaaacaagcaaccattgctgtttgatattgactgcattttgcaaatgcccaagaatcatgatatctaaggtaaatgttccttaaaacgttaataaaaagcaaaactgctactagacttctgttcctaaaaataaaatctgttcttaactgagggcaaatatcattatttggattagctggagtaactggaaataatatccaaagaaatgggtgtgtatagattccgctaaacaaaaatacaattgataggaagatcaattttgtttttcccagaccacctcctgtacctctctcccttgagcaagcagcccctaaataggtgcatagtcaaaccctggagctggagagaaaggaggcctgtggggtatcctcagccccctgaggaaggtacattccttgggatgggaattcttcctgaagcctccatggaaacatgacaccttagtcaggttccaagcagcaggccctgagctgagactgctggccctgagctgtgctgcccaggggaccactgcattctgccttgggggaattgtgcagaacagagagatggaaggaggaaaggaacatgacaatttacagaagaggggctccggcacccagaaataacataccacacctcaggtttcagggaacaagaagtgctagacaaaaaccataatgattttaacaggaaaaaaagagcaacttcagataccactccattacaaaacttaaaaaaaaaaactttctggaactaaaactgagttttaaatttaaaagttagtaatgaattcaaagaaaggaaaacgaagtagaataaacatcaaaacagaaacaatgggggagaagataagagatttggaggacatactttttccaaagcagtttcctctatactttaggagttttaccaacacacgcctgtgctgtgtcttttcaaaatatcctaatgggaactacagggatcttaagccaggaaaattcacttctaatcctttatcgcttctcttgctgcctccatctgtgtctttttctccttctggaattcctactattcacattatttctcctgcctgaaaagaaaccaaccctatcaacaccctcatcttaagacttctagcctccataaccgtgagaaaatttgttactagtctgtattactttgcatggcagccctagcatactaatacaacgtgttaccaaaccagacaaaaacatcacaagaaaactaacttctgaattctatgtactttaagaggatcgtatatggtatctaacaccaacttaaattagaaaagatatgtatttgtcataaacatcataattctattagatggcactattctaatcaaataacttatgatggatttatcgggatataacagtaagtaagagtatctgtatttgtattaggtgaagcattttgtctaacaggaggcataccgttaggataaatctaataggagtcttaatctgtcatgccttttcttaattatgatggctttttttttttaaacggggtcttgctttcttgctcagggtggtatgcagtactgcaatcacaactcactgcatcctctatgtctttacaagtgttcgctatcatacctggctaattaaaaattctgtttttgaaaagatagggtcttgccatcttgcccaggcttatcttgaactcctgagctcaaaccatcattccactctcggttcactgcaacctccacctcctgagttcaagcaattctcctgcctcagcctgggattacagatgcacaccaccacacctggcaaatttttgtatttttagtagagatggggtttcgccacattggccaggctggtcttggactcctggcctcaagcaatccgcctgccttggccctgctgggattaaaggtgtgaaccaccccgcccagcctgtgtcattttcaagagatctttttcctagccccagcccatatagttatctgaacttacaaagcgttgatgttcttctctaaatttttacacttacatctacaatgaacttggaattgattttttcatttccaaaagagttttacaattaatcaagtatcacaggctaatttcactcaagaactcagatgcaaaagtccaaaccaagtatcagtcaacctaatccagcaatatataaagcgatattatgaccaagttggatttcaggaatgcaagtgtagttgatcatttcaaactcaatcactgcaatttctcatactgatgtatcaatggagacaaagtatagaggtacttttttaatgttttatgagaaatgctaagctgaatttatgtcaaggaagaactgaggccatatatagtggctcacacctgtaatcccagcactttgggaggccgaggtgggcagatcacttgagctcaggagaccaccctgggcgacatggcaaaaccccttctctacaaaaaatacaaaaaaaaatagctgggcatgtggcacacacctgtaatcccagctacttggggggatgaggcaggattgcctgagcccaggaggttgaggctgcagtgagctctgtccacaccagggcactccagtgtgggcatcaaagtgaaaccctttctcgaaaaaaaaaaatgtggagggctgggcgtggtgggtgactcacgcctgtaatcccagcactttgggaggccaaggcaggtggatcacttgaggtcaggagtttgagaccagcctggccaacatggtgaaaccccccaccccctgccactccaccatctctactattagatgggcgtggtggtgctgcacacctgtaatcccagctgctcacgagcctgagaatcgcctgaacccaggaggcggaggctgcagtgagcctggatcctgccactgcactccagcctgggtgacagagtgagaatccgtctataaaaaaaaaaaaaaaggaaaacaaaaacaaaagtacatcttagagcgatcacatgaaaaagtattcctgctaataaatgaaaaggaatcgattattaaaatatcactaatttgaaaaccatttaagaaaataatggatctacataatgatcattaatagctgctgtaacatgacaaaagagaagataccaaccaatatgtgcctccggttggagcacagcacctcaagtaagttttctttccaaaaactctcatctgaatcaaaactacctccagactgggtgcggtggctcacaccagtaatcccagcactttgggaggctgaggcgggtggatcacctgaggtcaggaggttgagaccagcctgaccaacaagttgatactccgtctctactaaaaatacccctgtaatcccagttactcaggaggctgaggcaagagaattgcttgaacccaggaggcagtgagacaagatcacaccattgcactccagcctgggcaacaaaaccaaaactccgtctcaaaaacaaaaataaaaccaaaaccaaaaactacctctagaggtaactatcactttacaggaaatataaagaacagacactcaaagaccaccacggaaaaacaatcagaaaaatgcgaagtgtggggaaggaatgctgcaagacagcccgacaaatataacgggggatggagccttttaagaaaggggaacctctagatgatcacttacacagcatccattcaccacgcttgaaatgtgtaagtgtaaaactcacactggattttgacaagttcacaggattttgtttttaattattttagtcaagatcatggagaaatgaaaaagtgttttaaaattacatgcaaaatagtagtggatatatattaggttaaattattaatacaatgaatcatgtttccttttaccactaaagaatataagattacatttatagcatacattatatttctattggacagtgctgctctgaatttaaaaagttatctacaaaatataaggtgtgactttggatcctgactcaaaccaaccagctgtttaaaatatttaatacatgccgggcgcggtggctcacgcctgtaatcccagcactttgggaggccgaggccggcggatcacgaggtcaggagatcgagaccatccctgctaacatgatgaaaccccgcctctactaaaaatacaaaaaattagccgggcatggtggcggccgcctgtagtcccagcaactcgggaggctgaggcaggagaatggcattaacccgggagatggagtttgcagtgagctgagattgtgccactgcactccagcctgggtgacaagagcaagattccgtctcggaaaaaaaaaaaaatttaatacagaaacacttaaaccctggatacttgatattttggaatgtatttttaggcatgacagcagtatcatggttaggttttaaaagttcttagaaatactgcggatttatttattaataaagaccttattggtctgggatttgctgtaaaataagccagggcggtcttggctgagctcagttctccctctgcccaccctgttgccctccacaagaaccgtagctcagggcaactaagacagggcaagggccctggcaggggaggggtgtcccggtccaacttgggacccagttgggactgggtcccaagtcccaattgtgtccctggacacatgacttctcccaacctccattttctcatctgaaacatggggctaatagcaagcccttctggagtagtcctgagcatgtaattagaaaatggagtaaaacttctaggacctagtaagagtcaactaatgtggttctcccgaagagcagagaaccagagctcagtgggggagagggaattagagaagtcacctccaaggaaagggcctgtcacatttctgcagcccctgcaggcatctacccccaccgggctctcatttgcctccaggctttccaaggttctggccacgtgggagaagtaactttctatttactcagtcttttcccttaaataaattccattttttacctgaataaagctttataacgctacccttaacagaaaacttggcagtttacaaaaaagtggccgggcacgatggctcacgcctgtaatcccagcactttgggaggcagaggcgtgagaatcgcttgagcacaaaagtttgaaaatcaatctgggcaacataaggagaccccatctctacaaaaaatacaaaaatttgccgggcgtgctggagagtgcccgtggtcccagatactcggcggctgaggtgggaggatccgttgagcacaggaggatctcggcagcgagccgagatcacaccattgcactccagcctgggcaacaaagtgagaccctgtctcaaaaaataatacatatttttttatagagacggggtaggtctctggggcccaagcgatcctcccacacctcggcctccctaaatgctgggattacaggcgtgagccacctcgcccggccgataatgactctaatctacagaatgcacaccggaatgtaatacctacaagggaaaagatcttcttgcttaggaataaagcaatctctctcttaatattcattaaagtagtaatgtcttattttatagtttataaattctgtgagagcaacgagtcactttgcaggaatagcacttaaggtatctttcacctacctggagaacccaagaaattttcatcttactaggaattcagagacaaccacgtatttaacttttaaaaatataactaagtagaaagaattatatgcgtgtatttttggaagaattaagatgacttttgggacggaacgactgaaaactacgctttcagaactccctgccgcctgaggctgtggccctgaccccggcgcagggcccgccccgcgcggttccgggaagccgccgccgccgcccgttgcccttcgcgcgcagccgccagcgcgcgcctcgcgtcccgccacgcagatggccggcccgagcccccagcgcccgcgagcagtttcgagaactaaagaggcgcgtcagctcgtccccgggccgcccgcgggcaatggccgagctcggctctccttccaccctccgccgggacacacgcggagccgagcgggggtcccaggcgcctagggggaggggttcccgcgcccggggcggccttggggggagggcgagtcgggtgccttgctcctcaaaaccctggtccacgactctgcggttgggggagccgggcagccggcgcagcaggagccgggccccgtccacaagtttcctacgagcagggcggaatcgacgaaaatacttaatacaaacaaacaaaaggaaaaaaaaaaggacgactaagctgaagagcgcgcacgagtcagattttcaccccaaatacaaacacgatacctctaggagcaggagaccaatacagggaccgcgctccgaggacacgcggcgcagccgaggaggaaaaagggcccggggccgagagctaaggctacgggaaccgggcgtgggaggagggcggagccaactccccacaaggaagtcttgtgcaactctcaggcgcctgcagccacgtgagcgcgcggctttcattttactcaggtattattactattattacttcttttgagacaaggtctcatttccgtcgcccggctggaatgcagtggcacaatcactgtcactgcagcctcgacctcagagcaagcgaccctcccgcctcagcctcccgagtagctgggacaacaggcgcgcgccaccacacgtggctaatttttttttctttacttttcagtagagacagtctatgttgcccaggcttgtcgggaactcctgggctcaagagatcctcccggctgggcctcccactgcgccaggcctgttctcactttcagagccctccggcagtcgccagctccccgccagggggccggactaacgcacccggccgtccgtgccttccccgcgctttcctgactccaaaatctcagcccgcggtgctcaccgcgtgggaccactgtctgggcgtgcggctctcgacctccgacgctgcgtctcccgatcccagtgggtccagttcttgccggtcccacgtacgggcccctcgacctcgaatcccgtcacccaaatctcagcgccacggcccctcattatgtgcagtcctcgctcggtcccaggtttgcggcgcttaaactcagatcgctcttccctgatcccaaatcccagccccagcccaacgatccccaccccaataggcccagtccccaggtagtccgggtacggggccctggacttcggatagtctccctaatctcaaatcccaccccccgtccccacccccagggggacccggtccccgctaggtcccgggtgtgcggccttcgacctcggagacttcggccgcccctcacctcggcctccgagtctctacactcccgctctcatatcaggcaccccggtggtcccttggagcacctagaggagggtgggacgcggggaacttggcagttgtagcagaggcagttgaggcttgttgaccatcaccatggaaacccccgcctgcgagcacggggcggagcctacgaggggcggggtcaggcgcgctgccggccccaatcctcagcgcctgcccgtcgagcgcacgcggctttgccggaagccctcctgctcccggcgagccaggccccgactaggccctactgcccggctcagccctttgccctggacaccaggaaacagaagcccaaggagcccgcgtccccaccccctgctacctgccggcgtgacagcgattcggtggccccccgaaccccaccttgaggaagacgcggcgcagtcctgcttccacgacggagccggaaggacgcaaggaccgcggcagggcggagtttctgcgtccggcgtccgggggcggggccgcgacggcgcattgtgacgcgccagagctgagccgccggttggccggctgggcgcggagcagagccgacacggctggcgggggaggcggtggaggcggacaagcgaggacgtttctggagaggagaagggaggggaggggaggggatagggggagggggaggaggaggagggagtggagcggcgggaaagatccctctgactgcccctgaggccctggaggaaggacactggtgagccccgcaggacactgaaatgtgcgccgaaaggacgcctgatggaagactaggatgggaaaaggaaatgagagccgatggcagggcgtggtggcgcaagcctgtggtcccagtaatttgggaggctaaggcgggagaatcgcttgagcccgggaggtcgaggctgcagtgatccgtgactgctccattgcgtccagcctgggcgacagagcgaggcgctgtctcaaaaaataaaataaggaaagtagtacactgaaggccgggcgcggtggctcacgcctgtaatcccaccactttgggaggccgaggcggacggatcaggcggtcgggaaatcgagaccatcctggccaacatagtgaaacccctactaaaatacaaaaaaattagccaggcgtggtggcgcgcgcttgtagtcccagccactcgggtggctgaggcaggggaatcgcttgaacccgggaggcggagcttgcgtgagccgagatcgcgccactgcactccagcctagcgacagagcgagactacgtctcaaagaaaaaaaaaaaaaaaaggtacactgagtactccggagaccgcctaaaggggtctcagagcagggcgttaggagggatttgtcaggttgaagttgctcaggtgataaattccgtggtgtgagaagcccccaaacctcagaatgtaactcagacccaggtcgagggcaagattttcagtcacagagcacctgaacacacagatttggtggctaatggctaagccagggacagattttctttcttttctttttttttttgatgtattgtagggctaataattgtaaccattttattttggtggatcttcttcatgaagagatgatgtcaaggcactcatcacaggttaagctgaacattgttactattgttattatttccagactgagtatcgccctgtcattcaggcgggagtgcagtggtacaatcacggctcactgcagcctcgacctcctgggctcaagcgatcctcctgcctcaacctcctgagtagcaccaccactctcggctaaattttgtattttttgtagaggcgaggtttcgctgtgttgcccgggctggtcgggaactcctggactcaagccatccgcccacctacgcctcccagagtgttgggattactggattgagccacgcatctggctgaacgttattttttaaatcaccagagaaagtaaaggagtgctcaaaatagtgtcagatgatgagtgggatgattgtgatgaaggaaggagtttgttaaaagaaaaagctagttccaagaaagagaatggaaagagtaaagcaggagctgtcagaataggtaaaaatgtccaaagagaaaactgcataatttgaggcaaaattacagaaaatagttcctgcaaaaatcagataggtattcagcatcataggaaaggggcgaaaatcagataggtaggtattcttaagaagttgtggccggccgggcgcggtggctcgcgcctgtaatcccaagactttgggaggccgaggtgggtggatcacctgaggttaggcgtttgagaccagcctgggcaacatggcgaaaccctgtctctactaaaaatacaaaaaaaaattagccgggcgtgttggcgcgtacctgtagtcccatctaccctggaggctgaggcaggagaatcgcttgaatccaggaggtgatggttgcagtgagccgagattgcaccattgccctccagcctgggtaacaagagcgaaactctgtctcaaaaaaaaaaaaaaagtcatacagtgactgcatcacagctcatgctgtagaaagatgtttctggagagaaaaattcaagtagccaatttaaatcgaatattaggaaaattaaaccaaaagggctcacgcctgtaatcctagcactttgggaagccgagtcaggcggattacctgaggtcaggagttcaagaccatcctggccaacatggtgaaaccctgtctctactaaaaatacaaaaattagccgggcgtggtggcacatgcctgtaatctcagctactcaggagggtgaggcaggagaattgcttgagcccaggagatggaggttgcagtgagccaagattttgccactgcactctagcctggccgacagagcaagactctgtctcaaaaaaaaaaaaagaaagaaaattaaaccaaaagactagtaatgcttcagaaattagggactgttaaaccagctgcaagaagatatattcatgcaatctttgtattaagagtctctctggctgggtgcggtgactcagacctgtaatcccagcactttgggaggccaaggccagtggattgcttgagccctggagttcaagaccagcctggggaacatagtgagacccagtctgtattttaaaagttaaaaaaaaaaaaaagcctctaagctaagtggacctttgatcccctcactcaaatttgacagttctccattattcataaatgaggtaatagttgttggagacggtcttctctgaatgcaagactagtactttggcctgattatagaacttcctgccgtcctaaggagtcatcccaggtgtccactatatctttttcagcattgagtaccagcacagtcacatgtaggctttatcccacagtgaagacttggcatcactcagaatgatgccacaggtcctaggccttttccacactgggctcacttcaccaactcgcaaatgctcatccacacctggtccacctggactacctccttatctgtagccctttcacctctgtgtccatagaaatgtcttacctaagctctgaaatctaaacattcagagagcaccttgatgcttgagagcatctacacagagatgaacctttaagatctatggtttaaaacaattgaattccaagatgttgccccttacagactgacctgcctgattatttcctgttgtttatgtacattgattattatcaaaaacttaatactttattttttttgagacggagtctcgctctgtcgcccaggctggagtgcagtggtgcgatctcagctcactgcaagcttctcctcccgggttcacgccatgctcctgcctcagcctcccgagtagctgggactacaggcgcccaccacggcgcctggcaaatttttttttatttttagcagagacaggttttcaccgtgttagccaggatggtgtcaatctcctgacctcgtgatccgcccgcctcggcctcccaaagtgctgggattacaggcgtgagccaccgcgcccagccaaaaacttaatagtttttaataaatattgtcaggtttttttttttttttttttttgagacggagttttgctcttgtcacccaggctggaatgcaatggcacgatcttggctcaccgcaccctccacctcccaggttcaagcgattctcctgcctcagcctcccgagtagctgggattagaggtgcccaccaccaggcccggctaatttttgtatttttagtagacacggggtttcgccttgttggccaggctagccttgaactcctgacctcatgatccacccgcctccgcctctcaaagtgctgggattacaggcgtgagccaccgcgcctggccaatattgtcagttttaaaaaataagttcccctctagacactacttatccatacaattggttacaggtttggagcgttacagaggtttttaaatcttctactcagtagttcttgaaaaatcaccttacctattaagctgagattcccccttcccgcaagacggtgccattaagtaggcagggatcaccaaggttcagagatgtctcttgctcaaaaatcatagtatctgttaaatagcaataaccgtagctaacacatactgcattctcactatgctttgtgctattctacttaatcccactgaaacctggtaacaaccctgcagtagatactaccaccatttggcggaaagaaactgagtcacccagcttctagatggctgagctggaagttgtatggaggctggaggccccatctgattccagggtccgttctcaactactgcaatctagatcctagcgagaaacgggcttttcaggctgtctcctccctttcccatctgagaggagaatgaaggaagtgagaaagccaactgacctgtctagtcagtataggccctgtctaaatgtcacttttctccttgaagcgaggtgctctaggaggcagagataacccaggtgggaagaggcacattcggcagtgacagccttgtctggttaattttcatgaccaatatagaaaagtgcaactttgaggccgggcacggtggctcacgcctgtaatcccagcacttcgggaggccgaggccggcgaatcacgaggtcaggagattgagaccatcctggctaacacggtgaaaccgtgtctctactaaaaatacaaaaaattagccaggtgaggtggcgggtgcctgtagtcccagctactcgggaggctgaggcaggagcatggcgtgaacccgggaggcggaacttgcagtgagccgagatggcgccactgcactccagcctgggcgacagcgagactccgtctcaaaaaaaaaaaaaaaagaaagaaagaaaagtgcaactttgaagctgctctgatactcactgaagtgagctaccaccaggaaggctggatccctaggttatttgcaattctttcagagaacttgacagttctttcaaatagcactttttactgtgtattaaatagtgaaagaaggattatgggatacctgagcttgctggttacttgcttgaattggtttctttgcccaataaaggaccacagcttgattaggtggtagtggccagtgttggtggagtggctgcccttactttgcccatttccccagcaggccaagcaagcaactgagggactcacttggatgttagtaagctaagttctagctctttcttcacccttttattttatttttttgaggcggagtctcaccctgtcgcccaggctagagtgcagtggcacgatctgggctcactgcaaactctgcctgccaggttcaagcaatttttggataatttttgtatttttatttatttacttttattttatttatttatttttgagacggagtttccctcttctaccccaggctggagtacaatggtgtgatctgggctcactgcaacctcctcctcctgggttcaagcgattcttttgcctcagcctcctgagcagctgagatcacaggcacccaccaccatgcccagctaaagtttttttttttttggtatttttaatagagatggggtttcgccatgttggccagggttgtttcgaactcctgacctcaggtgatccgcctgcctcggcctccaaagcgctgggattacaggcatgagctactgcgcccagccaatttttgtatttttagtagggacaggttttcaccatgttggccatactggtctggaactcccgacctcaagtgatctgcctgccttggcctcccaaagtgctgggattataggcaggcatgagccaccacacctggccagctcttttttcattctaagtcatcatcttttagtctgatcatgagttttcctaccaaaaactgtgtacagttagatgccttcagctctatggagcctcagaagagtcagaaaacttcatttggatcaaaatgtgcaagggacaggacagcatgcaccttctctttctctctgcctttctttttctcctattaacttacatttaaaaaaaaattatggaatatttgaaacatacagaaaattatagatatataacaaatttaacagacattttgctcttttattgtttttggacaaaagataacagataggccaggtgtggtggctcacacctgtaatcccagcactttgggaggccgaggcgggcagatcacaagttcaggagttcgagaacagcctggccaacatggtgaaaccccatctctacaaaaaatacaaaaattagccaggtgtggtggcatgtgcctgtgcctgtaatcctagctttcgggagactgagggagaagaatcacttgaaccggggaggtggaggttgcagtgagattgtactccagcctgggcaacagagcaagactgtctcaaaaaaaaaaaaaaaaaaaaagattatagataaaccagtgctctgaggtgcttttcggctctttaaaaagcattactgggccaggcgcggtggctcatgcttgtaatctcagtgcttttgcaggctgaggtgggcgggatcacctgaggtcagaagttcgagataagcctaaccaacacggagaaaccatgtctgtactaaaaatacagaattaggcgggcgtggtagcacatgcctgtaatcccagctacttgagaggctgagacaggagaatcacttgaacccgggaggtggaggttgtgctgagtggagatcacaccactgccctccagcctgggaaacaagagcgaaactccatctcaaaaaaaaaaaaaaaaaaaaaattgcgaggcgcggtagctcacgcctgtaatcccaacactttgggaggccaaggcgggcggatcaccagagatcgggagttcgagaccagcctgaccaacatggagaaaccccgtctctactaaaaatacaaaattaaccaggcatggtggcacatgcctgtaatcccagctactagggaggctgaggcaggagaatcgcttgaacccaggaggcgcaggttgcggtgagccgagatcgtgccattgcactccagcctgggcaagaagagtgaaactctcaaacaaaaaaaaaagcattactggccaggcgtcgcagcggctcatgcctgtaatcccaacactttggaaggccgaggctggcggatcacaaggacaggtgttggagaccagcctgaccaacatggtgaaaccggtctctactaaaaatagaaaaattagctgggcgtggtggtggacgcctgtaatcccagctactcagggggctgaggcaggagaatcgcttgaacccgggaggcggagtttgcagtgagccgagattgagccactgcacactccagcctgggcaacaagagcgagactcagtctcagaaaaaataaataaataataaaataaaaagcaggccgggtgcgatggttcacacctataacaccagcactttgggaggccgaggtgggcggatcacgaggtcaggaattcgccaccagcctggccaacatggtgaaaccccgtctctactataaatacaaaaattagtggctgggggcagtggctcatgcctgtaatcccagcactttgagaggctgaggcgggaggatcacgaaatcaggagatcgagaccatcctggctaacacagtgaaaccccgtctctactaaaaatacaaaaaaaaaaaaaaaaattagccgggcgcagtggcaggcgcctgtagtcccagctactcaggaggctgaggcaggagaatggcgtgaacccgggaggcggagcttgcggtgagccaagatcgcaccactgctctccagcctgggtgacacagcgagactccgtctcaaaaaaaaaaaaaaaaattaggcgtggtggtgcgcgtctgtaatcccagctactccagaggttgaggcaggagaatcgcttaaacccgggaggcggaggtcacagtgagccgagatcatgccactgcactccagcctgggcgacagagcaagattctgtctcgaataataaataaataaaaattaaaaagcattactgtaaatatatttttttactttggtaactcaaaccattcagcctgtgtcctctccctctcattcccccacggaggagaagaaacctcaatggcgaaagcaacaccaagcgccggcttcacactcaggagaaaactgcacctcctgtcgtttccgggggctctacactttcacagaaagtactctagtagcagactatagaaatgatccctgaaagccgcctaatttttgaatgataaaatatttctaaattggtcaggcacagtggctcatgcctgtaatcccagcactttgggaggctgaggagggtgaatcacctaaggtcaggagtttgagaccagcctggccaacatgacgaaaccccttctctactaaaaatacaggccgggtgcggtggctcacgcctgtaatcccagcactatgggaggcttgaggcaggtggatcacctgaggttaggagatcaagaccagcctggccaacatagtgaaacccggtgtctactaaaaatagaaaaatcagctgggcgtggtggcacacatctgtaatcccacctactcgggaggctgaggcagaagaattgcttgaacccagaaggtggagtttgcagtgagccgagatggctctactgcactccagcctgagccacagagcgagactccttctcaaaaaaaaaaaaaaaaaaaaaaacaacaaaaaacctgaagataactttatatagtcagtggggagtattgaagtttcaggatcagagatttaataaaatttgtggccctttaggtaaatatctttaaagaatattgtttcaggcaacgtagtttgtgtgtgggtgtgtgctgtcttgacttagattttaggctctggctaaaagccagttagttcctcttcttgagctgccgattatgtctgcacccccaaccacctctgttatcaggctcaaacactcgggaccattatacaccgtaatcactccagggccagttaccagacaactagggccagccccatgcccctgagcccccggaaattactcaaattagccaatcccaaacctgttggccttgcctaacccttctcttcctgcaaaaaccacaacaaaggctcttctgcagttcccccctcactccctctgcctagtgaccccttctgctcctgctgagtggccttgtgtgaagccccagggaaatgagagtacaaaactaaaacttgggccaacgtggtggctcacgcttgtaatcccagcactttgggaggcagaagcaggcaatcacttgaggccaagagttcaagaccagcctggccaacatggtgaaaccctggctctactaaaaatacaaaaattagctgggcatagtggcgcgcacgcctgtagtcccaggtactcgggaggctgaggagggagaatcgcttgaaaccgggaggtggaggagcaacctcctctgggaggctggagctccactactctccagcctgggtgacggagtaaaagactgtctcaaacaaaaaacaaaaacaaaaactgtaaaactggtttgtaactcctgtgctgcatctaatctcaccatacctcacccaaggtaaactgttttgtttgtgtttttgtgtttgagacagagtctggctctgttacccaggctggagtgcagtggctcgatcttggctcactgcagcctccacctcctagatttaagcaattctcccgcctcaatctcccaagtagctaggattacaagcatgtgccaccaagcccaactaatccttgtattgttagtaaagatggggttccaccattggttggccaggctggtctcaaactcctgacctcaagtgatccacctgcctcagacccccaaagtgctgggattacaggcatgagccaccgtgcctggccaaatctgagctttttataaaatcttcatcataatggttcttaataatgttgactttgaagttttcttccctccaacaacagagagtggggaaaaaagatagttcataaagatcagttgatctttttaaaataattttttttaagacagagtcttgctgtattgcccaggctggagtgcagtggcacgatctcagctcactgcaagctccgccttcaggggtcacgccattctcctgcctcagcctcccgagtggctgggattataggcgcccaccaccacgctcggctaattttttgtatttttagtagagacggggtttcaccgtgttggccaggatggtctcgatctcctgacctcgtgatccgcccacctcagcctcccaaagtgctgggattacaggcgtgagccactgcacctggcctaaaataatttttaattgacaaataattgtacatattcatggggtacatagtgatgttttgatacatataacgtatagtgatcaggataattaacatccatcatctcaaatatttatcatttcttcctgttgggaacattcaatatttttctcctagctatttgaaactattatggtgaaccaaagtcatcctatggcatagaaaaccagatagctgtacttatgtatatcctttagcaaatctctccttatccttcctttccccctaccattccccttttaaatttttttttttttactttttggagacagggtctcactttttcgcccgggctggagtgcaatggcgcgcagtctggtctcactacaacctctgcctcctgagctcaagcgatcctctcatctctgcctccagagtagctgggaccacaggctctcgccagcacgccccgctaatatttgtatttttctttttatagagacgcgtctcgctatgttgcccaggctgatcttgaactcctgggctcaagcaatccgtctgtctccgttttccaaagtgctgggatcacaggagtgtgctaccgcgcccagccttgtttttttaaattattttttgttgaagggtcttgctgtatagcccaggatggagtgcagtggtgcgatcccggctcactgcagcctcgacctcccgggctcaagcgatctctccgtcctcagcctcccaagtagctgggaccacaggcgcgtgccaccaccgtgctcagctccttcccagtttaactgtggttaaaactggtgtgtgaaggcaatgagagagacccgcgaaaaatgagaaacaagggttagggctgacgtcttttgcggacaaagaaaaagaaaccaaagtttcctcagaaaacttaagttgcctcacagccgcctggtatcaggaaacactgagcccgcccaacgcgggatcctccaggggcaggccgcctgaggcccacccggagcaggcggggcggccgcaggaccacgtggcccagagcgcccttccagcgctgccggcggcggggcgggtgccgggcgcgcctgctgcgcggggcgggacgcggactcccaggctctgcggagagcggctgccactcgcctctgtttttttcttgagacctagtctggctctgtggctcaggctggagtgcagtggcgtgatcaccgctcactgcagcctcagcctcctctcgcctcagccgctcggtagctgggaccaccagcgggcgccaccactcccggctacatttttttgtatttttagtagagacgtgggtctcgccatgttggctaggctgctgccgaactccggggctcaagcgatccgcccgcctgggcctcccaaagtgctgagactgcaggcatgagccaccgcgcccggccgagagcctcttttggctcctcctttcgcctttccggggccaggcgtgtgcagctctgtgaagggtcccctccctctgcgggacgtcctcgctgccgaggtcagaggtgcggagaacatgagacccgaggtgcgttccagcatgttcctgcagccctccactcccgcggttgcgtaactcagatccctgaaacacatcgcacatacacgtgactggtggtttctctctttaaccctgatagatacaggagtccactaacagagataaggaattgtaccatgtactccatgcttcaataactgggtgcttagagacaagcctgagttcttactgccatcctaacacccgcagcagaggttaacctactatcggacaagtggtcaacttttctgccttcgggaagacttggggctgggctgagagagataatctagaacttttatagtgatcccgtgtacatttccctagaatgatggattagggtatagtgattaaatatataatgtatactttaatatacattaaaaagttctggaaggatgtacttcaaaatgttatcagtggtttcttccatttttcccgtttggaatattggaacaaccgactatgttattttagccctttctccttccttcattgcttctccaaattcaggggcctcattggagcaaacttgtttgcaggtcatctgggcaccctcttgaaataaatcgtctctctttgctcttacaggtctcaactgcttcttaccaatattaattccagtgactactatcagaatatgatgagcaatccactcatcagagaagctgtttctacactctcctgaatgaccattttatagatgctgggaaaaaattgtattaaagactatgagttagctgggcttggtggctcacgcctgtaatcccagcactttgtgaagccaaggcgggagcatcgattgagcctagcagttcaagaccaaccttggcggcataagcgagaccctgtctctacaaaaattttaaaattagccaggtgtggtggtgtgcacctataatcttagctacttgggaagctgaggtgggaggattactcagcctaggaggttgaggttacagtgagctgggatcacaccactgcccttcagcctgggtgacagagcaggaccccgtctcttaaaaaaaaaaaaaaaagtggtggactttgttatccttatgcatatgactcatcaatatatctgtatttccatatagaaagaacacttagaccgggcacagtgactcacgcctgtaatcccagcactttgggaggccaaggctggcggatcacttgaggccaggagttccagaccagcctggctaacatggcaaaaccctgtctctactaaaaaatacaaaaattagcctggtatggtggcacacgcctgtaatccctgctactccggaggctgaggaatgagaatagtttgaacctgggaggtggaggtggcagtgaatcaagattgcttcactgcactccagcctgggcgacagagtgagactccatttcaagaaatagataactaaataaataaaataaaagagaacacttagaaaggaacatgctatagcaaactaaaattatagatgtcaaaaatttaatctggattacccagcatctcctataagaaacaaaggggccctctccctctccctctccctctccctctccctctccctccccctccctctccctctccctctccctctccctctgatgccgagccaaggctggacggtactgctgccatctcggctcactgcaacctccctgcctgattctcctgcctcagcctgccgagtgcctgcgattgcaggcgcgcaccgccacgcctgactggttttcgtttttttttggtggagacggggtttcgctgtgttggccgggctggtctccagctcctagccgcgagtgatccgccagcctcggcctcccgaggtgccgggattgcagatggagtctcgttcactcagtgctcaatggtgcccaggctggagtgcagtggcgtgatctcggctcgctgcaaccacctcccagccgcctgccttggcctcccggagagccgagattgcagcctctgcccggccgccaccccgtctgggaagtgaggagcgtctctgcttggccacccatcgtctgggatgtgaggagcccctctgcctggctgcccagtctggcatccaggcagactggattaggcagtggttaagagtcatcaccactccctaatcttaagtacccagggacacaaacactgcggaaggccaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaataaattaattaaaaaaaaaaatttaatctgttatttgttactggaatatgttcattcttgcacttgggactagagttaagagtattttagaaattgcaaaccaaataatgaagctcccatgtagatctgactcagaaaaacacagaacactgtgcggaacaccatcccttttctcaccttatacccctattctacctcctccatccctggaaacaaggcaacagtcctcttttgtagttacacagtaccttgctttagacattctaactgccttcatcctctcaaaactagataatttaggtaagacttaagaagtttcagactgctggccggacacggtggctcatgcctgtaatcccagcactttgggaggccaaggtgggcggatcacctgaggttgggagttcatagaccagcctgaccaacatggagaaaccctgtctctactgaaaatacaaaaattagctgggcgtaggaaatgtatatatttccataaagtattgagtcttctgtttaatcacatcagtaggaatctaaaagcaattttggatttttttttttttttttgagatggagtcttgttctgtcacccaggctggtgtgctatggtgcaatctcagctcactgcaacctccgcctcccgggttcaagtgattctcctgcctcagcctcgtgagtagctgggactacaggtgcgtgccatcacgcccagctaatttttgtattttcagtagggatggggtttcaccatgttggccaggatggtctttatctcttgacctcacgatccgcctgccttggcctcccaaagtgctgggattacagacatgagcaccgcacctggctaattttggaattttttacaaaaaaactagattttgtttctgctgccacaaatattaattattcctactcaaaagcctggcagctgtctgcccactgctgtgtagaacatatttatgtgatcactacttcgcatggtaactctgagagatgggtggttttatctctcggagggacttgtccaatgtcatagaaatacattatacagccagacttgattgtacaaggcccagatatgcatggatttcgcttaccatggttttgttaagtaacatcagtctcccaacaacagggttcaaatatcagttactacagtatgttaagtatgagcaattacataaaatataaacttcgttgccagctcgtcagtgcacaaagcactgtgaataacaaatgtacatgatcagtgacaagttgcgtaatttctttgaaagtctgttatttcgttcactcatgcacagaaaggcatgtggttgtgttgcttcttgtctcccaccataccgggcctcttggtaggtttttacaaagaaaactaattctcaatatttctttctttctcttttcttttcttttttttattgttgttgttgggggatggagtctcactctgtcacccaggctggagtgcaatagtgtaatctcagctcactgcaaactccgcctcccggttccaagtgattctcctgtctcagcctcccaagtagctgagactacaggcgcccaccaccacacctggctaatttttgtatttttagtagagacagggtttcaccatgttgaccaggctggtctcaaactcctgacctcaggtgatttgcccaacttggcctcccaaagtgctgggattgtaagtgtgagccactgcgcctggcctcaatatttctaatgtattaaattacatagtaccagataaatattagttttactattttcatttccctgtacatttcaaactgaaagagtttttaatgttttggcaaaaaattttgaaagtcacagaacaatcataatttttctcattgatcattaagattgctttgcatggtatcagcttgtatgctcacttttacagtcttacactactttgtacttatggtatggtacttatagtactttttactgggcaaagcaaggagacacacacatgcatacacacatagcaaataaatcagtctggcttgagaggaagatggttagaataggactcaggcacagtgggtttctgtgcagctattcaccatttaggcaacttttccaaagttgcttagcttagcttccctgggataagttttctggacagcaaaataatgggtctttttttttttttgagacagagtctcgctctgtcgcccaggctggagtgcagtggcaccatctcggctcactgcaagctccgcctcctgggttcacaccattctcctgcctcagcctcctgagtagctgggactacaggcgcccgccaccacgcccagctaattttttgtatttttagtagagatgaggtttcaccctgttagccaggatggtctcaatcacctgacctcgagatctgcccacctcagcctcccaaagtgctgggattacaggcgtgagccaccgcgcccagctataacgggtcttaactgggactctttctcttctatcccagccagtctcacttctgccagccaggcctaactttcatcccttaagagagagagggccacttgattcaatatacaacgaagtaatgaatactgaatctataagtaagtctaccgatatctgtaaaagcagtgaaaagcaatttggtttcctaaaaatgttaactataaatattatttcctatcagtttgctgatttcctgtaagttggctgacttagccacaaagttagttttcattcatcttgaccacacctgacaggtctgtttccatggctgggatcctctccccatggttctttctggtgctgaaatgcacttgggcaaccatgccccttaaatgtgcctttatgggttagatgtggtggctcatgtctgtaattccagcactttgggaggctaaagcaggagaattacttgaggtcagctggagaccagcctgggcaacatagtgagacccccctccccctcaatctctttaaaaaaatgtttttggccggacacggtgactcatgcctataatcccagcactttgggaggccgaggcagatggatcacctgaggttgggagtttgagaccagcctggccaacatggaaaaacccccgactctactaaaaatacaagattagccaggtgtggtggcgcttgcctgtaatcccagctactcagcaggctgaggcaggggaatcgcttgaacccaggagacagaggttgcagtgagccgagatggcgccattgcactccagcatgggcaacctgagtgagaccctgcctcaaaaaaaaacaaaaaaaaaaacaaaaaaaaacggccagtcatggtggcttacgcctgtaatctcaccactttgggaggccaaggcgggtggatcacctgaggtcaggagtttaagactagcctaaccaacatggtgaaactctgtctctactaaaaatacaaaaattagccgggtgtggtggcgggcgcctgtaatcccagctacttgggaggctgaggcaaaagaatcgcttgaacccgggaggtggaggaggttgcagtgagctgagatcatgccattgcactccagcctggacggcagcctgagactatctcaaaaaaaaaaaaaagaaaaaaaaaaagaaaaagaaaatacatgtaggccgggcatggtggctgacgcctgtaatcccagcattttgggaggccgacgtgggcctatcacttgaattcagtagtttgaaaccagcctggccaaccaatagtgaaaccctgtctctaataaaaatttaaaaataagccaggcatggtggtgcgtgcctggagtcccagttacttgggaggctgaggcaggagaatcactagaacccagcagggaggctgagggagcagaatcactagaatccaggaggcggaggttgcagtgggctgaaatcacaccactgcactccagcttgggtgacagaggagactgtctcaaaaaaaaaaaaaaaaaagaaaccaaaaccaaaaaaaccacaaaatacatgtgaacatgtgctcacttcagcagcatatatagtaagattaaaatgcacatgaactcttacggaaaaaatatttctagtagtcagcaaatactgaaaatttattgagctctgtgcctgatggtatagaagttaagaagaattaaactgttctgtccttgcttttatttattttttaacgtgttggataccagcatccttgctttttttttttttgagacagagtctcgctctatcgcccgggctggagtgcagtggtgcgatgttggctcattgcaacctccgcctcctgggttcacgtgattcttctgactcagcctcctgagtagctgggattacaggcatgcaccaccatgaccagataattttttatatttttagtagagacaggggttcaccatgctggccaggctggtctcaaactcctgacctcgtgatctgcccgcctcggccttccaaagtgctgggattacaggcgtgagccaccgcgcctggccagcatccttgctttttagagcgcttactgccaagctgagggataagtcagatattatacgttttcagaaaagaagacacatgcaggagctgcatgtaattggaaacaaacagaatatttgagaattgaaaagtttgattaaatcacacagcaatgaaatataaagactaatataaaaatagcacatttccaatcaatccttatctgaaataaatgtatattgtgcacctgttaggaaccctatactgtactaaaaactaaattaaaaccaaccacattaagcccttgaagcaaagtcagagcaaaccctcctgaagcctatggagcagcgctccttcaccctccgtttcagatatcaagtccctgtgctgttcataaatgagacaaccttacaataagctgctttcaattcatagacattgggtcagtgcctttggtgtgaagtcatccatgttagggtacaatttcatgagtcgacaaacggagttagagtaagctccctatgcctccattctgagaaattttgcatccacagagtaaaagtcgatggatagcatattaggaggctgcatttttcttctatactttttttttttttagacagagtctcactctgttgcctagcctggagtgcagtgacgcaatgttggatcactgtaacctctgccttctgggttcaagcgattctactgccgcagcctcctgagtagctgggattataggcatgtgccaccacgcctggctaatttttgtatttttagtaaagttggggttttaccatgttggccaggctggtctcgaactcctgacctcaagtgatccactcacctcagcctcccagaatgttgggattacaggcatgagccactgcgcccggcctcttctatacatattagtaaaactcccacagcatactgcagcatattgtgaaataacagaataataagcaaggcttgtcagataaaggggttccaacccttcagggtaagtcaagaaaggcagtaccttagcatacagactgagcaacaggtcaggtttaagataggacttccattgttctgtctcagactagagctcattgtatgatacaggggccatttagccatgaaaagttgttgagcacctgaaatgtggttagtttggccaggcgcggtggctcacgtctataatcccagcactttgggaggccaaggctggcggatgacgtgatcaggtgatcgagaccatcctggctaacatggtgaaaccatgtctctactaaaaatacaaaaaattagccaggcgtggtgtcacgcacctgtagtcccagctactcgggaggctgaggccggagaatcacttgaacccgggaggcagcggttgcagtgagccgagatcgcaccactgcactccagcctgggtgaaagagcgagattctgtcgcgaaaaaaaaaagaaatgtggttagtgccactgagaggctgactttttattttattgtattgtattattttttgagccagggtcttgctttgtctgtaatcccagcactttggaaggctggggtgggtggatcacctgaggttgggagttcgagaccagcttggtcaacatggtgaaaccccgtctctattacaaatacaaaaatgagccaggtgtggtggcatgcgcctgtaatcccaactactagggagcctgaggcaggagaactgcttgaacccaggaggcagcggttgcagtgagccaagatggtgccactgcactccagcctgggcaacacagcaagactccgtctcagaaagaaaaacaacaataaactccactgtatgtatataccacattttgttcatccattcatctaaccagtggacacttgactcacctctatcttttgactattgtaaataatgctgctatgaagatgaacatacaatatctgagtttctgctttgaattcttttgcatatatacccaaaagtggtactgctggatcgtatgtatggtaattctgtttcctgaggatctgccagaactcttttccatagtgctgcaccattttacatttctatcaacagtacatagagctgacatttcttcatgtccttgccttaaatttaaaaacaaatactcattcagttattagaagacttttttttttccttttgagacaagagttttgctcttgttgcccaggctggagtgcaatggcatgatctcggctcactgcaacctctgcctcatgggttcaagtgattctcctgcctcagcttccttagtagctgggattacaggtgcccaccaccacgcccagctaatttttttgtatttttaatagagacagggtttcactatgttggccaggctggtctcgaactcctgatctcaggcaatccacccgcctcggcctcccaaagtgctgggattacaggcatgagccactgcgcccggcctagaagacttttaagtatgtttagaacaacttgggtatgtgaatctactttttcaactattattttattttatttttgagacagagtgttgctttgtcgccaggctggagtgcagtggcctgatctcggctcactgcaatctccacctccaaggttcaagcgattatcctgcctcaccttcctgagtagctgggactgcaggcacccaccaccatgtccagctaatttttgtatttttagtagagacggggtttcaccatattggccaggaaggtctcgatctcttgacctcgtgatctgcccgcttcggcctcccaaagtgctgggattacaggcttgagccactgcacccagcgtcaactattatttttatggattctaaataaaaattaagtatacccaggaagatatagcatatgcattgagatgtgctgtaataccaggtttcaaagacaatacagaaaaaaagaatgtcaaatgtctcatggataactttattaatcacatgtgaaatataatagtttggatatattgaatcaaataaaatattaacattaatttcacccgtttctttttacttttataaatgcagctagtagcaatttttttttttttttgagacagagtcctgctctgtcgcccaggctagagtgcagtggcgcggtctcggctcaccacaacctccgcctcctgggttcaagcaattctcctgccccagcctacggagtagctgggattacaggcatgcgccaccatgcctggctaattttatatttttagtagagacagggtttctccatgtcagtcaggctagtcttgaactcctgacctcagaggatccacccacctctgcctcctacagtgctgggattacaggcgtgaaccactgtgcctggctggcttatgtatttctatattctattctacagcactgctacagaggtagcctccactcataccacataattatgaaagccatcagattctggaagacagactccaagctgcaattgctgtaagtcaagtaatccctcttctccctcttttctgcccttaacatgcacatttattttccttttattattggattccctgaatggaaacatctgtccactattactgcagaaggctgggctgtcccatggtgactgtctggtgtccaggcttgagtaccctattttctgttttgttggttgtcctgtacagtgttgattaatttctgtgtctggggaagtctaggagtaggggatggggctgggtgatgctgacaacaccaagaaaagctcaggagatgtgtcaatgtgtttgcagagtctaaagagataccttccttccttctcttttgatttgacaatgccgccttaccaaaacttttcctgttcctcctgcagatttgtgggttttattttttatagagacagggtcccactgtgttgcccaggctggtctcaaactcctgggcttaattgatcctcctgcctcagcctcccaaagtgctaggattataggtgtaagccaccacactcagccacatttggggttttaaatttaattttatatttattttaattaattattttgagatagagtcttactctgttgcccaggctgtagtgcagtggcatgatcatggctcactgtagcctcaacgtcctgggctcaggtgatctttccacctcagcctcctgagtagctgggaccaccagcacttgctaccacacctagctaatttttttgtatgttttctgtagagacgggttttagccatgttcccagcctgttttagcttattaaaaaaaattttttttttttgagacggagttttgctcttgttgcccaggctggagtgcagtggcgtgatctcagcaattctctgcctcagcttctcgattagctgggattacaggtgcccgccaccacaccaggaaaatttttgtattttttatagagacagggtttcaccatcttggccaggctggtcttgaactcctgacctcatgatccacctgcctcagcctcccaaagtgctgggattacaggcgtgagccaccgcacctggcctaaaatttttttttttagagacagggtctcactacgttgcttaggctggtcttaaagttccaggctcaaatgattctctcaccacagcctcctgagtagctgggattacacgcatcagcccctgtgcctggctacatctgtggttctttttttttttttttttttgagatggggcctccctatgttgcaatggcacgatctcagctcactgcaacatctgcctcccaagttcaagcgattctctcacctctgcctccccagtagctgggactacaggcttgcgccactatgcccagctaatttttgtattttttttttttttgagacagagtctcgcactgttgcctaggcagtggcgtgatctcggttcactgcaacctctgcctcccaggttcaagcgattttcccacctcagcctgccgagtagctgggattacaggcgcctgccaccatgcctggctaatttttttttgttttttgaggcggagtcttgctgtgttgcccaggctggagtgcagtggcgcaatctcggctcactgcaagctccgcctcccgggttcacgccattctcctgcctcagcctcccgagtagcactttgggaggccgaggtgggcagatcacctgaggtcaggagtttgagactaacctggcgaacatggcaaaaccccatctctactaaaaataaaaaaattagctgggtgcagtggctcgcgtctgtaatcccagcactttgggaggccaaagcaggaggatcacttaagctcaggagttcaagaccagcctgggcaacatggtgaaaccttgtctctactaaaaatgcaaaaatgagccaggcgtggtggtgtgtgcctgtagtcccagctacttgggaggatgaggcaggagaatcgcttgaacctgggaggcagaggttgcagtgagtcaagatcacaccccagcactctagcctggacaacatagcaagactcagtgtccaaaaaaaaaaaaaaaaaaagaaatgtttgttttggccagatgcagtggctcacagctgtaatcccagcactttgggaggccaatgcaggaggaggatcacttgagcccaggagttagagaccagcctaggtaacatagcaagtctgtgtctctccaaaaaaatttaaaaatcagctgggtgtggctaggaacggtggctcaaccctgtaatcccagcactttgggaggccaagaaggacagatcatgaggtcaggagtttgagaccagtctggccaacatagtgaaaccccctctctactaaaaacacaaaaagttagccgggtgtggtggtgtgcgcctgtaatcccaactactccggaggctgaagcaggagaatcccgtgaacctgggaggtggaggttgcagtgagccgagatcgcaccattgcactccagcccgggagacagtgcgagacaccatctcaaaaaaaaaaaaaaaaaaaaatcagctgggtgtggtggtgaccccctgtcgtcccagctaccgggaggctgagaggctgaggtgggaagattgcttgagctgtcaaggctgcagcgagctgagatcctgccactgcactcctggctaggggatggtgcaagaccctgtctcaaagagttaaaaaaaaaaagaaagaaaaatttattttgatttttcattagagtataggctctgaagtttcatttgtgcatatgagttacgtatccttcatatataagtgtatctatatttgccgtgtctaccagtcagactacaaaaggcatacatatggtggaatgatgatttgctatttcagtgaatgcatatattcctcactgtgaactagttattatttggggctgttagttgctgcaatgagacatcacacctctgaaaccatggggtgtcttaggagacttgttagagggcttgttataccatttggacttgtggctggtgattttggggagggtccaaggacaggggtgtgttttggattggtgctgtactaacaggggcaactcaaagattattattatttttttttttgagatggagtctcgctttttcacccaagctggagtgcagtggcgcgatctcggctcactgcaggctccgccccgcggggttcacgccattctcctgcctcagcctcccgagtagctgggactacaggcgcccgccacctcgcccggctaattttttgtatttttagtagagacggggtttcaccgtgttagccaggatggtctcgatttcctgacctcgtgatccgcccgcctcggcctcccaaagtgctgggattacaggcgtgagccaccgcgcccggccactcaaagattatttcaacaattttaggtggggcgcggtggctcatgcctgtaatcccagcactctgggaggccgaggcaggcgatcacttgaggtcaggagtttgagaccagcctggccaacctggtgaaaccccatctctactaggtggcaggtgcctgtaatcccagctattcgagaggctgagacaggagaattgcttgaacctgggaggcagaggttgcagtgagccgaaattgtgctacttcactccagcctgggcgacagagcaagactccttctcaaaaaaaaaaaaaaaaaattttttttaaatccagaaagcaggaggaatagagaggagctaaagctgtcattggagaaaaagcagtaattactcatgctagctgaagaagggatgtttattcttctgtgtgtgtggttgcgcagtgccagtttttatttatgcaggcaagatcactgatcggaattattttctccttccctcagtcacagaaagaactcgtctgatatcaattttctgtgaacctgtttatgttcatcaagtaatccaggccagctaccgtgggtctcagggcttttttttttttttttttttttttttgggacagagtctcgctcttgttgcccaggctggagtgcaatggcgagatctcggctcacagcaacctctgcctcccgggtgcaagctattctcctgcctcagcctcccgaataactgggatcacaggcatgtgccaccacacccagctaattttgaatttttagtagagttggagtttcaccatgtaggccagactgatcttaaactcctgatctcaggtgatccacccgccttggcctcccaatgtgttaggattacaggcgtaagccaccacgcccgggctttttattttttttcttaatgatgctgcacctaatcacatttaggtggcaggcaaaagaatattgcttagctgctttgctacagaaatgacaactcttgggcaggggcgcggtggctcacgcctgtaatcctaccactttgggaggccgaggccagtggatcacctgaggtcaagagttcgacaccaggccgggcacggtggctcatgcctgtaatcccagcactttgggaggccgagacgggcggatcacgaggtcaggagatcaagaccaacctggctaacacggtgaaaccccgtctctactaaaaatacaaaaaattagccgggcgtggtggcgggcgcctgtagtcccagctactcgggaggctgaggcaagacaatggcgtgaccctgggaggcggagcttgcagtgagctgagatcgcgccactgcactccaccctgggtgacagagcgagactccgtctcaaaaaaaaaaaaaaaaaaaaaaaaaaagagttcgacaccagcctggccaaaatggtgaaaccccatctctactaaaaacaaaaaaaattaaccgggcgtggtggcggacgactgtaatcccagctactcgggagcctgaggtaggagaatcacttgaactcgggaggcggaggttgcagtgagccaagatcgcgccactgcactccagcctgggcaacaagagcgaaacttcgtctccaaaaaaaaaaaaaaaaaaaaggacaacttttgatccctgaggctgctaattccaactgtgtgcatgtgcttaacaaatacctccgcacccaggcctgggaagttggctgatttgtgtacagcaaatacggcaggcctgatgtagcagaactctgacgaaaacgaactggacgcgtatttctcctgcagcgaaggtcacgctgctgacagcctctgctttgcactttgtccctgggaaggaggcctgtggccagtcctacctcctggaaagccggggtgcgtcagaggacctgatgcggagcggggaccccatcctctccgtgtctccccaagagccggcggcagaggctgcctgcgctccttaagctaggtcagttctctggcccgcagttctcgttctcctaacatcctccgcagaaaacgaccttcattttttcctcttgcgccagtcttgaagcggggcgtcctttgggctcacgttgcggcgcccagcggcctcaagcgtcagctgcctccagggcctcaggagcagtggctagggcctgccctccagcgcccggggtcctcggcccagccctgctccgagcgcgtcacaatggcgtcgcggccccgcccccggacgcccagccgcggtcccagcgaccttcgctttcgtggggaagccggactgcgccgtgtcttcctgaagaaggctggggtaagagtccggccagcggacaagagggcagctggtagcagggtgggatgcccgtggcatagggccgagcccccgctaggcacgcgggagcagcaaggcttccggaagcgcagggagcgctggactggcgggcgcccgggattcgcgcaggccccgcccctcggcggccccgcccagggagcgctgcggcagtttccatggtgagatggtcaacaagcctgtaagttcctcagctacgactaccaggtacctcgggttcctccctcctccgagagaccgccgaggtgcgggctgtgagagggggagcgtggagcctccgaggccgaggtgaggggcggccggcgggcaggggccgggtctgaggtcgagggccgcacacccaggatcgagcggggactgggcccgctgggggtggggaccgtggggctgggatttgggatcagggcgagtcgtggcagagagaacccggaggatctttgaccccagtgcgggagcggccagcccaccctagagaagcgagacaagggcaaccagaaggaaccgagtctgaggaagcgcttcctctgggcagggatattgggagagtcctggacgagtgaccctggacctaggaggcatgagaggtctacacacacttgcaaggataccttcatgattgttgagttgtggtgagaaaagaggctctttttagtttattttttaaggcagtacattcacatccttaagagtcagaaacttgcacaaggccttattactcaaaactcccttttcccagttccttctgaggaaatagttgcaaatctttgaacttttttcctccggaaattttctttttttctcttacatcggcagctcttcactgtgttcttccttcattagctttactaagtttgtattctttggttggaaatatttatttatttatttatttataaatagaaacaggggtatcactatgttgctcaggctggtcttgaactcctgggctcaagtgattctcctgctttagctttccaaagtgcggggattacaggctgaaccaccgcctgccaccgaaatatttcttcattgagttcctttgcctcctagtgttacttttctgctgtgtgtgtaatagccatttgttttttctttctcctttctggtcatatccttaaatacattttgcactaattccttttgaaacctcatcatggagagaacttgaatttagcagattaggggtgagtgcaggcttttgtcttaggttccatatatatatatattttgaggtggagtctccctctgtcgcccaggctggagtgcagtggcgtgattttggctcactgaaacctccacctcctggcttcaagcaattctcctgcctcagcctcccaagtgacgagggttacaggcacgtgccaccacacccggctaatttttgtatttttagtagagacagggttttgccttgttggccaggctggtctcgaattattgacctcaggtgatccacctgcctcagccccccaaagtgctgggattacaggcgtgagccactgcacccagcccccatatattaagaaatatacccttgtgtattgttggtaagaatgtaaaatggtacagcagctatggaaaacagtatggcagttccctcaaaaaattaacaaatagaattgccatatgatccagcagtaccacttctgggtctgaatccaagagaaatgaaagcggggactcagttacttgtacagtcatgttcatagcagcattatttgcaatagtcaaaagggagaggtaaccccagtgtccattgatagatggataaacaaaatgtgtcatatacaatagaatatcattcagccttaggaagaaaatcttggctggatgcagcggctcatgctggtaatcccagcactttgggaggccaaggtgggaggattgcttgagtccaggagttccagaccagcctgagcaacatagcgagatcctgtttccacaaaaaataaaataaaataaagaatacaaaaattagctgggcaggccgggcgcggtgtctcacgcctgtagtcccagcactttgggaggtcgaggtgggtggatcagagggtcaggagtttgagaccagcctggccaatatggtgaaaccttgtctctactaaaagtacaaaaatattagccgggcatggtggcacatgcctgtaatcccagctacttgagaggctgaggcagaagaattgcttgaatccgggaggccgaggttgcagtgagccgagatcacgccactgcactccagcctgggtgacagaacgagattccgtctcaaaaaaaaatcagctgggcattgtggcatgtgcctgtagtcctagctactctggaagctgaagtcggaggattacatgtgcctaggaggttgaggcttcagtgagccatgattgcactgctgtactccaccctgagtgacagagcaagactccatctcttcaaaaaataaaaataagatggccgggtgcggtggctaacgcctgtaatcccagcacttggggaggccgaggagggcagatcacctaaggtcaggagttcaagaccagcctggccaacatggtgaaaccctgtctctactaaaaatacaaaaattagctgggcatggtggtgggcgcctgtaatcccaactactcaggaagctgaggcagggagaattgcttgaacctgggaggtggaggttgcagtgagccgagatggcaccactacactctagcctgggtgacagagtgagactccatctcaaaaataaataaataagtgaaaataaaaaagaaaatgtcatatgctgcaacatggatgaatgttgacgatattatgttaagtgaagtaaaccagtaatggacaaatattgtatgatccccacttatatgagaatctgaagtagtcaaattcatgtaaacagaaaagtagaatggtggttgctagaggctgcggtaaggaggaatgggaagttgtttaatgggtacagagtttcagatttgcaagatgaaaatgttctagagatctgtttcacaacaatgtgaatctacttaagactgaactgtacactttaaaaaggttaattggtaagttttgttttatatatatatatatttttttttttgaggcgaagtttcactcatgttgcccaggctggagtgcagtggagagatctcagctaactgcagcctctgcctgcccggctcaagcaattctcctgcctcagcctcccgagtagctaggattacaggtgcccgccaccatgcctggctaattttttatatttttagtagagacgggcttttggcatgttggccaggctgatctcaaactcctggcctcaggtaatacgcccgcctcggcctcccaaagtgctgggattacaggtgtgaaccactgtgccctgcctatatttttaatcaaaggagtttaaggacgggcacagtggctcacacctataatcccagcactttgggagtccgaagtggtaggatcacctgagatcagcagtttgagaccagcctgttcaacatggtaaaaccctatctgtaccaaaaaatacaaaaattagcccggcatggtaatgcttacctgtagtcccagctacttgggaggctgatgtgggagaatctcttgaatctgggaggcagaggcagcagtgagctgagattgcgccactgcactccagcctgggcaacagagtgagactctgtctcaaaaaaaaaaaagaaaaaaagaaacagaagactaccctcatatttgtggtcctttgtgtagttccgcctcatggctccctcctttgccctagggtaaccactgtcttcaactttatgcttgtcacttaacttgcttttctttataatttgactaaaattgtttgtatcccaaaaaaagacatattgagtagttttgcataaccttggactttttttttgttgtttgtttttgagagagtcactgtgttgcctaggctggagtgcagttgtgtgatcatagttcactgtagcctcgatcttcttggctccagaaatcctcccaccttagcctcccaagtagctaggaccacaggtaaatgctaccacacctggttaaattttttttttttttttttttttttttttttttttggtggagacagggtctccctgtattgcccaggctggtcttgaactcgtgggcttaagcaatccttccacctcagcctctcaaagtgcaggtattacaggcatgagccaggctgctttcaaactcctaacctcaagtgatccacttggcttggcctcccaaagtgctgggagtatagacatgagccactgcaccagaccgctttgcctttttttttgagacggagtctcactccttcgcccaggctggagtgcagtggcacgatctcggctcactgcaacttccgcctcccgggttccagcaattctcctgtctcagcctcccgactagctgggactacagacacctgccaccgggcccggctaattttttgtatttttagtagagacggggtttcaccttgttggtcaggttggtctcgaactcctgacctcaggtgatccacccacctcggcctcctaaagttctgggattacaggcatgagccaccgcgcctggccaatttttgtagagacagggttttgccatgttgccccagctagtcagggtctctctgtcacccaggcgggagttgcagtggtgcgatctcggctcactgcaacgtctgcctcctgggttcaagtgattctcctgcctcagcctcctgagtaccttggattataggtgcatgccactgtgcttggctgatttttgtatttctagttgagacggggtttcaccatgttggccaggcatgtcttgaactcctgacctcaagtgatccacccgcgttggcctcccaaagttctgggattacaggcgtgagccaccatgcccagccttcccctgtctttacatataaattttagaataaggttgtttataaaatatcttgctgtggttggccatgtaggcttatgcctgtaatctgagtgctttgggaggtagaggcgggaaaatcaaagtcaggagttcaagaccagtctggccaatgtagctaaccctgtctgtacgaaaaaaaattttaaatttagctggatgtgatggcacatgcctgtactgtagtcctagctacttgggacactgcggtgtaaggtttgcttgagctcagacgtttgaggttatagtgagctatagtaacaccactaacactgtaccctagcctggtctacagagggagaccctgtctctaaaacaacaacaacaacaacaacaacaacaacaaaaaaaaaacaaagaaaaaaactcttgctgtgaatttgataggaaaaatgttcaatttatatattgttttggaattttggagagcactgacgtctttattctattgagtcttttaatccattaacatagtacgtctcttcatttgcttagattttcctgaatttatttatttatttatttatttatttttttgagacggagtttcactctgtcacccaggctggagtgcagtggcacgatctcggctcactgcaacctccaccctccgggttgaaatgattctccttcctcagcctcctgagtagctgggactacaggcgcctgccactgcgcctggctaattttttgtatttttagtagagatggggtttcaccatcttggccaggctggtcttgaactcctgacctcgtgatccacccgccttagcctcccaaaatgctgggattacaggcgtgagacaccgcgcccagccctggaattattttataagcattttgtagtattcagggtacaagttgtgttcagcgtacaagtctgatatgtgtttgttagatttatagctaagtgtgcttgcttcgacagcacatatactaaaattggaatgatacagagattagcaatttaaagtattttttaaatttatagcttagtaattttttcaattattacaaatggtattttatttttaatttaatttaggtgtccatgttttattgctaatatatagaaatacagttgattttttagttgagcttatgttctatgacctttctaaacttactcgttctagcttttttttttttttttttgagacagagttttgctcttgtcgctcaggctggagtgcaatggcatgatctctgctcactgcaacctctgcctcctggattcaagcaattctcctgcctcagcctcccgagtagctgggattacaggcacccgccaccacgcctggctaatttttataatttttaggagagacgaggtttcaccatgttagccaggctggtctcgaactcctgacctcaggtgatccacccaccttggccttccaaagtgctgggatgacaggcctgagctatcctgctgggcctagtttttgtttttgtttttttttttttgagatggagtcttgctctgtcacccaggctggagtgcaatggagcaatcacggctcactgaaacctccccctaccgggttcaagagattctcctgcctcagcctcccaagtagctgggattacaggcacatgccaccgcacccagctaatttttgtatttttagtagagatgaggtgtcaccatgttggccaggctggtctcgaactcctgacctcaggtaatccacctgcctcagcctcccaaagtgctgggattacaggagtgagccaccatgcccggcccgttttttttgttttaatcaattttttttgtagagatggaggtctcactatgtcacctagggtggtctcaaactcctagcctcaagcaattccccccaactcagcctcccaaagtgttgggagtacagacacgaaccactgcacctagtggaggagttgtctttttgtatattgcttgaattttttttttttttttgtagacacagtctctctctgtcacccaggctggagtgcaatggcgtgatcttggctcactgcaacctctgcctcccgggttcaagcgattcctctgcctcagcctcctgagtaactgggactgcaggtgtgcaccaccacacctggctaattttttgtatttttagtagagatggggttttcaccatgttagccaggatggtctccatctcctgacctcgtgatccgcctgcctcggcctcccaaagtgctgagattacaggcgtgagccaccgcgcccggctcctaaaagttttctaacaaagctccttctctccttgtcctttggctagaaagcgacagattttcttaggcttttaaaatctgtacccattgatgttttcagattgctggcttctgtaacatctagtctgggatatatgaggcaaaaagaatacccagtgaacccagcactgtgtcgttctttgagttccaagatcccgtgctggtctgctattttctacctttcagtccatatcatgtttatttatatataatttcagggtattgagctttacttaatgggaggagtatgaagcagtaccctgaactggaagtgttgctttcatttttgaaagacatttttgttgccgggcgtggtggctttcctttgtttaggtttcattgagcttcttggaattataggtttacaggttgttcgttttttgtttgtttgtttgtttttgagattaggtttcactctgtcacccaggctggagtggcatgatctcagctcactgcaacctctgcctccgggctcaggtcagcctctcatctcagcatcccaagtggctgggaccacaggcgcacaccactccaggctaatttttttatgtttttggtagagatggggtttcaccatgttgcccaagctggtcttgaactccagagctgaagtgatcctcctgcctcggcctcccaggcagtgctgggattacaggtgtgagccactgcagctggccttagatttatgggtttttattgtaagggtagaaagatttaggccatcatctctttgaatattttttatgccaacaaccccccatcctccttccagttatgtatatcttaggctgctttaaatcatgacacagctcagtgatgttcttttcattgttttggatttttttttcagaaatgaacttagttgcctttaagttcagtaatcttttcttctgtaatgtctaatctgctgttcatttcattcagtgtatttttcatctcaaacgtggttttcattttcagaatttttttttttttctttagagacgagatcttactaggttgtgcaggctggtcttgaattcctgggctcaagcaattttctcacctcagccttccaaagtgctgggattataggtgtgaatcaccacaactggcccactttcagaattttgactggatgtttttatatctttcctatactgtaattctcattgtaggtcatgttttcttgcctgtttgcatgcctggtatcttattggatgttaggcattgtgaattttactttttggatgcaggatatttttgtattcctgtgaatcttcttgagctttattctgggatatagttaagttacctgaaaacagtttgttctctttggtttttgtcttttcaggattattaggcaggtccagggcattgttcattctggggcaaattattccccactgctaaggctagatcttcctgagtactttacccaatgggccatgaattatgacattttctttttttttttttgatcctcaaaaattttattttattttgttttaatttttttttagtatttattgatcattcttgggtgtttctccgaggggggatttggcagggtcataggacaatagaggagagaagttcagcagataaacatgtgaacaaaggtctctggttttcctaggcagaggaccctgcggccttccgcagtgtttgtgtccctgggtacttgagattagggagtggtgatgactcttaatgagcatgctgccttcaagcatctgtttaacaaagcacatcttgcaccgcccttaatccatttaaccctgagttgacacagcacatgtttcagagagcatggggttgggagtaaggttatagattaacagcatcccaaggcagaagaatttttcttagtacagaacaaaatggagtctcctatgtctacttctttctacacagacacagtaacaatctgatctctctttctttgccccacgtttcccccttttctattcgacaaaaccgccgtcgtcatcatggcccgttctcaatgagctgttgggtacacctcccagacggggtggtggccgggcagaggggctcctcacttcccagacgtggcggccaggcagaggcgccacccacctcccagacggggtggctgctgggcgggggcgccccccacctcccagacggggtggccgggcggagactctcctcacttcccagacggtgcggctgccaggcggagaggctcctcacttctcagacggggcggccgggcagaggcactcctcagttcccagacagggtcgccgccgggcagaggcgctcctcacctcccagatggggtggtggccgggcagaggcgctcctcacctcccagacggggtggcggccgggtagagatgctcctcacctcccagacggggcggccgggcagaggcgctcctcacatcccagacagggcggccgggcaggggcgctccccacatcctagacgatgggcgcccgggcagagacgctcctctcttcctagacgggatgacggccgggaagaggcgctcctcacttcccagactgggctgccgggcagaggggctcctcacatcccagatgatgggcggccaggcagagacgctcctcacttcctagaccgggtggcggctgggaagaggctgcaatctcagcactttgggaggccaaggcaggcggctgggaggtggtggttgtagtgagcggagatcacgccactgcactccagcctgggcaacattgagcactgagtgagcgagactctgtctgcaatcccggcacctcaggaggccgaggcaggcagatgactcgaggtcaggagctggagaccagcctggccaacacggcgaaaccccgtctccaccaaaaaaaaaaccagtcaggcgtggcagcgtgcccctacaatcccaggcactcggcaggctgaggcaggagaatcaggcagggaggttgcagtgagccgaaatcgaggcagtacagtccagcagagggagacggtggaaagcgggagacggagatgagggagagggggagaccgtggaaagcgggagacggagacgacggagaggggagagggagaacaacattttttttttgagacagagtctcgctctgttgcccaggctggagtgcagtggcacgatcttagctcactgtaacctccacctcacggattcaagtgattctcctgccttagcctcctgagagctgggattacaggcatgtgccaccatgcccagctaatttctgtatttttagtaaagacggggtttcactatgttggccaggctggtcttgaactcctgacctcaagtgatctgcctgcctcgggctcccaaagtgctgggattacaggcgtgagccaccacgcacagcctgaattatgacatttctaatctgcctggtgtaggaacaggcactattccatgccctgtgtgagcactgggcactattccctctgatctttttagatggttcttttgacagatgtgggtaatgcccttatactcatgtactgatcaatacactgctgagctctcaagtgggacgctgcaggtctctggggttttctctccatgcagctctttcttctctggtgctgtgttctgtgaattctagctgcctgtgtctccccagactatcaaatctatcttttcaactcaaggaatctgccaggctctgccttagttatttttccttgtagcacattctacaaactactcaagtcagttagctggggcacttgtaggactcatctcatttgtttcctatctcttagggattactctctgttttctgatgttcagggtcttggaaaccattttttttttttttttttttttgagacggagtctcactctgtcgcccaggctggagtgcagtggtgcgatctcggcttactgcaagttccacctcccgggttcacgctattctcctgcctcagcctccggagtagctgggactataggtgcctgccatcatgcccggctaattttttgtattttttgtagagacggggtttcaccgtgttggccaggatggtctcgatctcctgacctcgtgatccacctgcctcagcctcccaaagtgctgggattacaggcgtgagccaccatgcctggccaattggaaaccatttttgtccttacgttttgtcaaaaaatgttttttttttccaatataacctggtccctgttactcaattcgtcttgcgctgaagtggagaattgaagatggggcatcaagcattcatttcatctcttattgaattctaataataaaagtacagttgacccttaaacaaaatgggtttgacctgtgtgggtctatgtatatgtggatttttttcttttttaaggagatggggtcggctgggtgcggtggctcctgcctgtaatcccagcacattgggaggccgaggcaagtggatcacttgaggccaggagtttgagactgacctggccaagatggcgaaaccctgtctctaccaaaaatataaaaaattagctgggcgcggtggcgcacacctgtagtcccagctatcggggaggctgagacaggagaatcgcttgaaccttggagatggaggttgcagtgagccaagatcttgccactgtactccagcctaggtgacagaggaagactccgtttcaaaaaaataaatatataaaaataaaaaaaatgagctgggcattgtggcagatgcccatagtcccagctactggagaggatgaagcaggaggatcacttgagcaggagatagaggctgtggtgagctctgattgcatcactgcactccaggctgggtgacagagtaagaacctgtctccgaaaaaaaaaaaaaaaaaaaaaggctgggtgcagtggctcaggcctgtaatcccagcactttgggagggtgagccaggcagattgcctgagctcaggagtttgagaccagcctgggggacatggtgaaaccctgtctctactgaaatacaaaaaattagcagggcatggcggcgtgggcctgtaatcccagctactttggaggctgaggcaggagaatcgcttgaacctgggaggcgaaggttgcagtgagccaagattgtgccactgcactccagcctcagcgacagagcgagactctgtctccaaaaaaaaaaatcaactgtatatctaatggtactgaaaagagagaaaccacaagacactggtatatattgacatacacaagtcacagagaatagaaatggactggatgttgaagcacagtgatgcatatattattattcaagtcaactcactatttaaagctaatttcataggaaaattctacttaattcagtctaacattatgtaagtaaccaaggaagagttaacagctgtgttacagaagtgaactataagcttgtgaattcagtatttaaaaaaaaattccttttcagtattttgtaatgcttcaacatgcattttgagcttatttctgtttatattgttgtaatgttcctcagcagttaacatgtattgaagcattttttttttttttttaatgagactgagtctcactctgtcgcccagtctggagtgcagtggcactatttcagctcactgtaacctccgcctcctgtgttcaagtgattttcctgcctcagcctcccaagtagctcgaattacaggcacccaccaccactcctggctaatttttgtattattagtagagacggggtttccccatgttggccaggctggtctcgaactcctgacctcaggtgatccacctgccttggcccccaaagtgctgtgattacaggtgtgagccaccatgccaggcctgaatgtttacttttacttttaatgtaagttttaatttaaatactgatacttgattcagttattggaaaacttttttgttttgagacggagttttgctctttttgcccgggctggagtgcaatggcacgttcttggctcactgcaacctccgcctctcgggttcaagtgattctcctgcatcagcctcccgagtacctgggattattggcatgtgccaccacacccggctaggctaattttgtatttttagtagatacagggtttctccatgttggtcagtttggtctcgaactcccaacctcaggtgatccatccgacttggcctcccaaaatgctgggattacaggtgtgagccaccaagcccggcctcttttttgctttgtttttttttgagacggagtctcactctgttgcccaggctggagtgcaatggtgagatatcggctcaccacaacctctgcatcctgggttcaagtgattctgctgcctcagcctcctgagtatctgggattacaggaatgtgctaccacacctggctaattttttgtattttgagtagagacggggtttcaccatgttggccaggagttcgactcctgacctcaggtgatctgcccgcctcggcctcccaaagtgctgggattataggcgtgagccaccatgcccagccggaaagcttttaagtgcccagaataatttgggtgtgtgaatgcctttttatccatagtaaatttaataaaatctaattatagatcaagtatttctgatgtaaatttagcatctaaatttaagtggctgtgaagtataaaataacagtagataccaatgacttagaagaaaaaaaagccttgacatctctatttcctcgtctctaaaggtgataacacttgcactatggtgatcctactagtaatacatttggagccacgttgtaaacttcagagtttgcaccattattattatttttttattattattattttttgagatggagtttcgctcttgttgcccaggctggagtgcaatggcgcgatcttggctcactgcaacctccatctcccaggttcaaggattctcctgccccagcctccctaatagctgggattacaggcatgtgccaccacgcccagctaattttgtatttttagtagagacggggtttttccatgttggtcagactgcttgtgaactcccgacctcaggtgatacgcttgcctcggccttccaaagtgctgggattacaggcgtgaaccaccatggatggcctattattattattattagagatggagttttgctcttgttgcccagtctggagtgcaatggtgcgatctcagctcactgcaaactccacctcctggatccaagtgattctcctgcctcagcctcctgagtagctgggattacaggtgtgcgccaccaggcctggctaattttgtatttttagtagagacggggtttcaccatgttggtcaggctggtctcgaagtcctgatctcaggtgatccacccgccttggcctcccaaagtgctgggattatagacttgagccactgtgcctggccaaagtttgcaccattattattattattatttttcttttgagatggagttttgctcttgttgcccaggctggagtgcaatggcgtgatctcggctcactgcagcctccacctcccgggttcaagcagttctcctgcctcagcctcctgagtagctgggattacaggcatgggccaccacgcctggctaattttgtatttttagtagagacggggtttctccatgttggtcaggctagtctcgaactcccgacttcaggtgatcctcctacctcagcctcgcaaagtgctgggattacaggcgtgagccaccgcacctggccagtttgcaccattattatgggagcacttgcaaagcctgccagttgatggtagggtggaaaagaagaggacaactagaagagagttcctacaccgcaaagtaaactttgctggctctgcgaggagcaggaaacctgcatgatgagaacaaggactgggtggcactgcaggaaatgctcaattcgagtttcacttcctgtgttatcactttttctttgctgcaatttcatctttgttggtcaattctcttttaattttccatttttttacattctatgtaaatgtagtttttatgaactagagagtctgactccatattttatctttgactactgtcagctctcaagccccacctcttccctccccttctgtcccacacctggatggctgattcaaaagcccaggtgcttcctcttttggctctaaaggcaagttcaagccatgcaggccccagcatgtgcattggagccttcatttcccccccactccttaaccttaataacacccaaagccagtctctcttccctgctctcaagccatttttttttcttctttttctggagacagggtcttgtgtcacccaggctggcgtgcagggccctgatcacagctgccagtagctggaaccacgggggtgtgccaccacgcctggctaattttttaattttttttttgtagagatgaggagtgccactgtgttgcccaggctggtctcaaaactcctgagctcaagtgatcctctcttggcttggcctcccaaaatgctggggttacaggcatgagccattgcacccagccttaagctatttttgaacccatttgggattcatccctgttctccccagaaagcctcatgtgagtcataagcctttacatattctctctgtgcatgtggggctgtcaccagttttgaaaaaccaggttttgggtggggaatctatctcgtatctttgggtaatatcacagataaatacagcagacattaacattttattcagtaaccactgacagtaggggaaagagctgagctccattctgatttgtgcagtgatgatcgggctttttttctttttttggtggttggatattttatacctttttttccccaaatactctccactgaatgtagtcgactggtgattttaaagggggaatgagggagtatggaggggtatgagttggggctcagtagagttggggatgtgaaaaattacaagggaccagtgtaaatgtgatgaggccagcggtgtctgcctgctggcaatggtcaaagttagattccatcctcccacagagactgggagacagaggccttatctttcccaatcactacatttcaaagcaatggctccttgagaaagcaatgttccttgagaaagacacttcttagctgtaggagatacacacttgcatacacatacacaacatgtgtatcacataaacatctcaaagggacagaggacagattcataattgtaagtcctttttagtaaatgctcttaagagagggcggtcaggagcctatggtcagatattggcaagaatagtaagttatcctggcagcactgagatttctcaggcaggcattttaatggtggggacaggggtcatcctgggaacacaggctatgctactagaagccatgccaatttgtctctcagtgcagagtttcagatggagttatggggggagagttctgcagttctcagtaaccacaacagtatatatcactggaagatgaagcccacacaactacagatgttactgtttctgagtgagccgaataacaaacttacagtgagcagtcaccaacagacagaagtgatgtgattggttactgatcatgacatgcatttgttattaatgtgatgatgtgtagactgaagagctagcagcctgcactttatgcgaaaactcacagttaatatactgtgtacctgaaatttgagttgtgtcgttgggggactggtgttattaaatcatggtgactgaaattcgtgcatatcagaactgtaccaagcaagggctgcctgatgagtataatgctctcatgttttatgggaatttatataaatttaaaataatatgaataaatatttgaaagttgtatgttatgcacaaggtttgaaataatgcaattcttttaatattttaaaaaattgttaggactcagattttcttttatcttttcttttttttaaggtacggagtctcgctctgtcgcccaggctgaagtgtagagtgcagtggcatgatctcagctcattgcaacttccacctcctgggttgaagcaattcttctgcctcagcctccggagtagctgggaatacaggtgcaggctgccacgcccggctcatttttgtgttttagtagagatagggtttcaccatgttgcccaggctggtctcaactcctgagctcaggcaatcctcccgccttagcctcccaaagtggtaggattacaggcgtgagccactgcacctggccctcgactcacagattttcaaaatacttttgaacagtaagctgaggacagtgtttattatgactatactggtctcctttcactagctcacaaaatttaactacatcacttgtcagtctcctaaaaatgcagtgtatgtgctttgaaacttgtgaatgatctgctgatttgtgctattttatattcaatgttgttgaaagaatagtttttaaaccaagtaatgcaaaaatttagtgtaacatgaatgcttgtgctgtaaaacatactggaaaatcaatagctctggaataaactttggatttttaattaaaattgattttgatgtacttatgctgttaaattggtagagactagtctgaaaagctgagaaaagataaagcagaattaaaacaaaatctatcttattcgtagagccatgtcaagaatgcattctctctacacctattccaatgggcacattagtacttgattatgcagggagtgaatcatgccaagtcttcacgtacacattgctcctatcactgctgtgcagtgagccgtgactgcgccactacactccagcctgggcaacagagccagaccttgtctcaaaaaaaaaaaaaaaaaaaagtcctttaagggatacgaggctgtgtgtgatagtcgttttcttttagtttgcacttttttttttttttttggagacagtctcgctctgttgccccgtccggagtgcagtgggtccatctcggctcactgcaagctccgcctcccgggttcaaggccttctcctgcctcagcctcccgagtagctggaactataggcgcccgccaccacgcccggccaattttttttgtattttttagtagagacggggtttcaccgtgttagccaggatggtctcgatctcctgacctcctgatccgcccgcctcggcctcccaaagtgctgggtttacaggcgtgagccacggcgcacggcctagtttgcacttttattcacccccaaattctgtgtattgcaagtaagtctcaaattttgagaagcgagcaccatcccattggcatcgtgactaccaaccaccacatcactcagctgctttgctttccgggagaatccctgcgccgtgggttcgctcgcctttccatgcctgccgtgcaggcgtcctttgcggtcttttgtccacgtccgggtcaacgcctgacgcgccccttcccggctggacgacgcagctcagggcggggcgaggcgaggttgtgtcgcggaacctgacgggaaacggcccctctaggtccgtggcgcggcgcgcttgtggcagcgacgggcactgccgcgcatgcgcggcccatttccgagagtggcagggctgggcgcggtggggtcgcctctggggtcaaagagcacgccgagcccgccggagggcggggccgcggccttggccctttggcgcgtaggagacagcgcgccaggctggcagccggccttagcggcgtttgctgctcttgtgcggacgccactgcgcgccctagtggggactacggggacgcttcgcgctccaggaaggaggcgggcaccgcccgctctagcacagtccgggagctggacctcggggttcaccgctctgcttgcccactaaaagcccattcggcggaagtccagcgttgcatggttacagtactgagccccagacatcgttgccaagtataatgcaggctctgttttatcctggggcacttgtagtcagggttcgtgggcccgcacttcataatggagggctgcgggcctcgtctgaaccgtccagccagtgtgtcctcagtcgtcttggttgggtttttgaagaaccaacccgagattctggggcacagggagttacaagacttggggccctgatgtaagccccaaataaaatgattttggcccctagggccagatccgagtttctaaaaacagagcagcacttgtaaggtagaggaagcgtggcccacctgaatggggacttctcaccagagtttcacagcagcggaagacgaggctgaggaagagcacggcccatatttgcacggagaggcaatatgtaatgcctgtgctccacaagccaccccagctgactcaacaggagttttgctccagctgtcagagaggtgagctgggcctaaggctagggttaggcttgcccaggaaatgtctctccattttcagggttgagagaacctggttgggagggaaagaaatattactacctctaagaaaattatttttctttttcttttgagatggagtgtcgctctgtcgcccaggctggcgtgcagtggtgggatctcggctcactgtagcctctgcctcccgggttcaagcgattctcctgcctcagcctccagagtagctgagattacaggtgcgcgacaccatgcccggttaatttttgtatttttagtgaagatagattttcaccatgttggccaggctggtcttgaactcctgacctcaggtgatccgcgcgcctctgcctcccaaagtgttgggattacaggcgtgagccactgctcctggccaagaaaattatgtcttaaacaccccaacggcctttgaatttttctgaattatttactcattccagataccgagagcttcccatactatgccaattaccgcaggtggccttgagagatgtgggtgcttccaccatgcttactcagaaagtagttcaggaaacagtttcctggattaccaatttctgcctgacatgaaagatgaaaaccactgaactccagaggggtgaatgtccaggtcatcccattcattagctactccagaggctgaggcaggagaatcccttgagcccggaaggcggaggttgtagtgagccgagatagagccactgcactccagcctgggtgacagcgtgagactccatctccagaaaacaaaacaaaacaacaaaacaaaaaccctagcgcggtggctaacgcctgtaatcccgtcactttgggaggccgaggggggaggatcacaaggtcaggagttcgagaccagcctggccaacatagtgaaaccccgtctctactaaaaataaaaagatagctgggcatggtggcgcatgcctgtaatcccagctactccagaggctgaggcaggagaatcgcctaaaccctggaggtggaggttgcagtgagccgagattgcatcactgcactccagcctgggcgacaaagcaagactctgtcttggggaaaaaaaaaaaaaaaaaagaaaaagaaaagaattcctcatgagatcgcttgaacgcgcgagttggaggttgcagtgagccgagatcacaccactgcactccagcctgggcaacagagggagactccgcctcaattaaaaaaaaaaaaaaattcctcatgagacattaagagttacagctctttgccgggcagggtggctcatgcctgtaatcccagcactttgggaggccgaggcgggcggatcacgaggtcaggagatcgagaccatcttggctaacatggtgaaaccccgtctctactaaaaatacaaaaaattagctgggtgtggtggcgggcgcctgtagtcccagctactcgggaggctgaggcaggcgactggcctgaacccgggaggcggagcttgcagtgagctgagatcaggccactgcactccagcctgggtaacagagcgagactccgtctcaataaaaaaacaacaacaacaaaaacaaaacaaaacaaaaaaaaagagttacagctcttttagaatttgtctggcaggctttccagtttttgccagtgtgaacccaaaatatctgagataggcctcagttaatttagaaagtttattttgccaaagttgaggacacgcgcccatgacagcctcaggaggtgctgatgacatgcgccaatgtgggcagagcacactttggtttcgtacattttagggagacatgagacatcaatatatgtaagatgaacattggttcagtccggaaaggcaggacaactggaatcaaaggtgggacaacttgaagggcaggtggcttccggggtcttaggtacagaagagacaaatagttgcattcttttgagttgctaattagcctcttcaaaggaggcaatcagctttgcatttatcttagtgagcagaggggtaactttaaatagagtgagatgcaggtttgcccttagcagttcccagcttgacttttctctttagcttagtgattttggtgccccaagatttattttcctttcaccctggaaagccccttaaaaacaaaaaacaaaaaacaaaaaacagttcttggcattgaagtctaaaaaacattgtttttccggtcttcctgtagatgacttagtagagagtcttcagtctttcagtgagtaccagaaatcagtgcagtctgctgcttgtaattgagtacttcgtgtgggtcgagtactcagtcagtacatttctagggatggaggcaccttggtcccatagacctctttctgatggtcctgcttgatccaggcatagaagctgggatagctgcatgaaagaatggattatgtcaccttcagatacactccttaaatgtatgtgtagattgtacaacagcaaggttaaagctgtattttctggcaagtatctccacatttccctttcttattttgaacaacatgacttgctggatctgcctggtaggggtatccaaatgtcatggatactttagtgcttgccttaattgagcattctgtccagttgatgctcatgtttaatctccctaaaatgtcttctcagttggtttctgatctagtccttcctctgtaattatttcttttctgtcttgtccgtgaagtcttcttcctcttcctgcctctcattattgctgttcccaaggtatccagtctttttctttctttctttctttctttttttaggtgtagtctcactttgtctcccaggctagagtgcagtggcatggtcttggctcacttcatcctccgcctcccaggttcaagtgatcctcctgcctcagcctcccaagtagccgggactacaggtgtatgctaccacacctggctagtttttgtacttttagtagagacagggttttgccatgttggccaggctggtctcgaactcctgacctcaggtgatccacccaccttggactccccaaatgctgggattacaggcgtgagccactgcacctggcccttggtttgctgagactttttatcatccagtgggtattgaacttttaaaaaaaaatttttaagtcaggtctcactctgtcacgcagtctggagtgcagtgttgcgatcacagctcactgcaggtaactctgacttcagtctcccaggtagctggaactgcaggtgcacagcacaatgcctggctaatttgtttattttttgtacagacagggttttgccgtgttgctcaggctgtgagtttattattattattattattattattattattattattattattattttctgagatggagtctcgctctgtcgtccaggctggagtgcagtggctcaatctcagctcactgcaagctctgtctcctgggttcacgccattctcctgcctcagcctcccgagtagctgggactacaggcgcctgccaccacgcccagctaattttttgtatttttagttagagacagggtttcaccgtgtcagccaggatggtctcgatctcctgacctcatgatctgcccgccttggcctcccaaagtactgggattataggcatgagccaccgtgcccggccgttgaattattattatttttttagctaatagaccagaagaatgaatttaattattattgagatgattatattgttttattctttttcagtggattgattgatattaacctatggattgagttaattttattaatgttttgattttcaaatgttaaatcagcctattttccaggaacaaagtcatattgttgctttatccttttaaaatatattccatgacaaattgttagatatttttgtgtctttgttcctgaaagagtctgttgttttctttctttcttttttttttttttttttttgagaccaagttgtcgcccaggctggagtgcagtggcatgatctcagttcatggcaacctctgcctcccgggttcaagcgattctcatacctcagcctcctgagtagctgagattacaggtgtctgccaccatgcccagctaattttttgtatttttagtagatatggggtttcaccatcttgaccaggctggtcttgaactcctgacctcagatgccacccgcctcagcctcccaaagtgttgagactacaggtatgagccaccatgcctggctgttattttcctttcttaaaagtctttttttttttttgagaaagagtctcactctaatgcctagtctggagtgtagtggccctatctcagcttactgcaacctttgcctcccgagttcaagcgattcttgtgcctctgcctcccaagtatctgggattacaggcaggcaccaccaggactggctaatttttgtatttttagagagacagggtttcaccatattggcctggctggtcttgaactcctggcctcaagtgatctaacaccaccttggtctcccaaagtgctgggataacaggcgtgagctatcacacccggcctcttctaatatcttaattttttttttttttgagacagagtttcgctctcatcgcccaggctggagtgcaatggcgtgatctcggctcactgcaacctccacctccccagttcaagcgattcccctgccttagcctcctgagtagctaggattataggcgttagccaccacacccggctaatttttgtatttatagtagagatggggtttcatcatgtttgtcaggctggtctcaaacttctgacctcaggtgatctgcctgccttggcctcccaaagtgttgggattacaggcgtgagccaacatgcccggcccagtcttttgttttttttttttttttttgagacaaggtcttgctctgtcacccaggctggagcgcagtggtgtgatgatcataactcacctctcccttgaactcctgggctcaagcaatcttctgatctcagcctcctgagtagctgggactacaggcatgtaccataatgcctggttacttttttgtattttttttagagatggtgttttgctatgttgcccaggctggtcttgaactcctgggctcaagtgatcctcctgtcttggcctcccaaaacatcgggattacaggtatgagccactgcccccggcctttgttaggtttatatcaattttatgcctgtttcagaaaacatgtttagtgttttctctttattctccatgagtgcttgtgtaagattggtgctatttattccttaattgcttgtaaaattacagcagtgaatttttctagggtctggcttttctttatgaataattttaaaattatagatttaatttctttatattagggaaattatcctttagaacttgatacaagtcctagttgtttgtttctaccttgtcatttgtcatccccaggtgggtggcaggtgtgtttgttccagggcaaagctatgtctcacacacactagttcacataaccccattcagaccaaaaattgttcacagtttactttgctttttgtctctttatctccaaggttggtctgtagtgaactcaaagccttaattctatcccagtccttttagttaaggtcagcagtgacctctagtggtgaaatcttcagtcttcctcttaacatgactttcttttttaaaaattatctagtgaattactctttctgtttgtttgtttttgagatggagtcttgctctgttgcccaggctggagtgcagtggcacgaccccagattactgcaacctctgcctcccgaagtgctgggattgtagggttga
